(12) United States Patent
Howard

(10) Patent No.: US 10,188,746 B2
(45) Date of Patent: Jan. 29, 2019

(54) PYRROLOBENZODIAZEPINES AND CONJUGATES THEREOF

(71) Applicant: MEDIMMUNE LIMITED, Cambridge, Cambridgeshire (GB)

(72) Inventor: Philip Wilson Howard, Cambridge (GB)

(73) Assignee: MEDIMMUNE LIMITED, Cambridge, Cambridgeshire (GB)

( * ) Notice: Subject to any disclaimer, the term of this patent is extended or adjusted under 35 U.S.C. 154(b) by 0 days.

(21) Appl. No.: 15/510,397

(22) PCT Filed: Sep. 10, 2014

(86) PCT No.: PCT/EP2014/069248
§ 371 (c)(1),
(2) Date: Mar. 10, 2017

(87) PCT Pub. No.: WO2016/037644
PCT Pub. Date: Mar. 17, 2016

(65) Prior Publication Data
US 2017/0340752 A1    Nov. 30, 2017

(51) Int. Cl.
| A61K 31/5517 | (2006.01) |
| C07D 519/00 | (2006.01) |
| C07D 487/04 | (2006.01) |
| A61K 47/68 | (2017.01) |

(52) U.S. Cl.
CPC ...... *A61K 47/6851* (2017.08); *A61K 31/5517* (2013.01); *A61K 47/6803* (2017.08); *A61K 47/6855* (2017.08); *C07D 487/04* (2013.01); *C07D 519/00* (2013.01)

(58) Field of Classification Search
CPC ............ A61K 47/6851; A61K 47/6803; C07D 487/04; C07D 519/00
See application file for complete search history.

(56) References Cited

U.S. PATENT DOCUMENTS

| 4,816,567 A | 3/1989 | Cabilly et al. |
| 5,362,852 A | 11/1994 | Geoghegan |
| 5,440,021 A | 8/1995 | Chuntharapai et al. |
| 5,583,024 A | 12/1996 | McElroy et al. |
| 5,621,002 A | 4/1997 | Bosslet et al. |
| 5,644,033 A | 7/1997 | Seon |
| 5,674,713 A | 10/1997 | McElroy et al. |
| 5,700,670 A | 12/1997 | Yamagishi et al. |
| 5,773,223 A | 6/1998 | Shyamala et al. |
| 5,792,616 A | 8/1998 | Persico et al. |
| 5,854,399 A | 12/1998 | Salomon et al. |
| 5,869,445 A | 2/1999 | Cheever et al. |

(Continued)

FOREIGN PATENT DOCUMENTS

| EP | 0522868 | 1/1993 |
| EP | 0875569 | 11/1998 |

(Continued)

OTHER PUBLICATIONS

Amiel et al., "Heterozygous endothelin receptor C (EDNRB) mutations in isolated Hirschsprung disease," Hum. Mol. Genet. 1996, 5, 355-357.

(Continued)

*Primary Examiner* — Shirley V Gembeh
(74) *Attorney, Agent, or Firm* — Melissa E. Kolom; Casimir Jones, S.C.

(57) ABSTRACT

A conjugate of formula (A): Wherein Y is selected from formulae A1 and A2: $Z^1$ is a $C_{1-3}$ alkylene group; $Z^2$ is a $C_{1-3}$ alkylene group; Q is: where $Q^X$ is such that Q is an amino-acid residue, a dipeptide residue or a tripeptide residue; L is a linker connected to a cell binding agent; CBA is the cell binding agent; and n is an integer between 0 and 48.

17 Claims, No Drawings
Specification includes a Sequence Listing.

(56) References Cited

U.S. PATENT DOCUMENTS

| | | |
|---|---|---|
| 5,976,551 A | 11/1999 | Mottez et al. |
| 6,011,146 A | 1/2000 | Mottez et al. |
| 6,153,408 A | 11/2000 | Abastado et al. |
| 6,214,345 B1 | 4/2001 | Firestone et al. |
| 6,218,519 B1 | 4/2001 | Kenten et al. |
| 6,268,488 B1 | 7/2001 | Barbas, III et al. |
| 6,518,404 B1 | 2/2003 | Li et al. |
| 6,534,482 B1 | 3/2003 | Fikes et al. |
| 6,555,339 B1 | 4/2003 | Liaw et al. |
| 6,602,677 B1 | 8/2003 | Wood et al. |
| 6,677,435 B2 | 1/2004 | Barbas, III et al. |
| 6,759,509 B1 | 7/2004 | King et al. |
| 6,835,807 B1 | 12/2004 | Susaki et al. |
| 7,223,837 B2 | 5/2007 | De Groot et al. |
| 7,375,078 B2 | 5/2008 | Feng |
| 7,521,541 B2 | 4/2009 | Eigenbrot et al. |
| 7,723,485 B2 | 5/2010 | Junutula et al. |
| 9,102,704 B2 | 8/2015 | Howard et al. |
| 9,387,259 B2 | 7/2016 | Jeffrey et al. |
| 9,388,187 B2 | 7/2016 | Howard |
| 9,399,073 B2 | 7/2016 | Howard et al. |
| 9,399,641 B2 | 7/2016 | Howard |
| 9,415,117 B2 | 8/2016 | Howard |
| 9,464,141 B2 | 10/2016 | Asundi et al. |
| 9,526,798 B2 | 12/2016 | Jeffrey et al. |
| 9,562,049 B2 | 2/2017 | Howard |
| 2001/0055751 A1 | 12/2001 | Reiter et al. |
| 2002/0034749 A1 | 3/2002 | Billling-Medel et al. |
| 2002/0042366 A1 | 4/2002 | Thompson et al. |
| 2002/0150573 A1 | 10/2002 | Nussenzweig |
| 2002/0193567 A1 | 12/2002 | Jacobs et al. |
| 2003/0060612 A1 | 3/2003 | Goddard et al. |
| 2003/0064397 A1 | 4/2003 | Spancake et al. |
| 2003/0065143 A1 | 4/2003 | Eaton et al. |
| 2003/0091580 A1 | 5/2003 | Mitcham et al. |
| 2003/0096743 A1 | 5/2003 | Senter et al. |
| 2003/0096961 A1 | 5/2003 | Baker et al. |
| 2003/0105292 A1 | 6/2003 | Liaw et al. |
| 2003/0109676 A1 | 6/2003 | Li et al. |
| 2003/0118592 A1 | 6/2003 | Ledbetter et al. |
| 2003/0119121 A1 | 6/2003 | Baker et al. |
| 2003/0119122 A1 | 6/2003 | Baker et al. |
| 2003/0119125 A1 | 6/2003 | Baker et al. |
| 2003/0119126 A1 | 6/2003 | Baker et al. |
| 2003/0119128 A1 | 6/2003 | Baker et al. |
| 2003/0119129 A1 | 6/2003 | Baker et al. |
| 2003/0119130 A1 | 6/2003 | Baker et al. |
| 2003/0119131 A1 | 6/2003 | Baker et al. |
| 2003/0124140 A1 | 7/2003 | Bangur et al. |
| 2003/0124579 A1 | 7/2003 | Mack et al. |
| 2003/0129192 A1 | 7/2003 | Chenault et al. |
| 2003/0130189 A1 | 7/2003 | Senter et al. |
| 2003/0134790 A1 | 7/2003 | Langenfeld |
| 2003/0143557 A1 | 7/2003 | Penner |
| 2003/0157089 A1 | 8/2003 | Xu et al. |
| 2003/0165504 A1 | 9/2003 | Retter et al. |
| 2003/0185830 A1 | 10/2003 | Xu et al. |
| 2003/0186372 A1 | 10/2003 | Baker et al. |
| 2003/0186373 A1 | 10/2003 | Baker et al. |
| 2003/0194704 A1 | 10/2003 | Penn et al. |
| 2003/0206918 A1 | 11/2003 | Fanger et al. |
| 2003/0219806 A1 | 11/2003 | Glucksmann et al. |
| 2003/0224411 A1 | 12/2003 | Stanton et al. |
| 2003/0224454 A1 | 12/2003 | Ryseck et al. |
| 2003/0228319 A1 | 12/2003 | Frantz et al. |
| 2003/0232056 A1 | 12/2003 | Fanger et al. |
| 2003/0232350 A1 | 12/2003 | Afar et al. |
| 2004/0001827 A1 | 1/2004 | Dennis |
| 2004/0005320 A1 | 1/2004 | Thompson et al. |
| 2004/0005538 A1 | 1/2004 | Chen et al. |
| 2004/0005563 A1 | 1/2004 | Mack et al. |
| 2004/0005598 A1 | 1/2004 | DeVaux et al. |
| 2004/0018194 A1 | 1/2004 | Francisco et al. |
| 2004/0018553 A1 | 1/2004 | Billling-Medel et al. |
| 2004/0022727 A1 | 2/2004 | Stanton et al. |
| 2004/0044179 A1 | 3/2004 | Baker et al. |
| 2004/0044180 A1 | 3/2004 | Baker et al. |
| 2004/0052793 A1 | 3/2004 | Carter et al. |
| 2004/0101874 A1 | 5/2004 | Ghosh et al. |
| 2004/0101899 A1 | 5/2004 | Dillon et al. |
| 2004/0121940 A1 | 6/2004 | De Groot et al. |
| 2004/0197325 A1 | 10/2004 | Law et al. |
| 2004/0249130 A1 | 12/2004 | Stanton et al. |
| 2005/0271615 A1 | 12/2005 | Shabat et al. |
| 2006/0116422 A1 | 6/2006 | De Groot et al. |
| 2013/0028917 A1 | 1/2013 | Howard et al. |
| 2013/0059800 A1 | 3/2013 | Howard et al. |
| 2013/0266595 A1 | 10/2013 | Flygare et al. |
| 2014/0030279 A1 | 1/2014 | Polakis et al. |
| 2014/0030280 A1 | 1/2014 | Polakis et al. |
| 2014/0294868 A1 | 10/2014 | Howard et al. |
| 2015/0273077 A1* | 10/2015 | Van Berkel et al. ........................ A61K 47/48723 |
| 2015/0315196 A1 | 11/2015 | Howard |
| 2016/0015828 A1 | 1/2016 | Torgov et al. |
| 2016/0074527 A1 | 3/2016 | Flygare et al. |
| 2016/0144052 A1 | 5/2016 | Howard et al. |
| 2016/0250344 A1 | 9/2016 | Howard et al. |
| 2016/0250345 A1 | 9/2016 | Howard et al. |
| 2016/0250346 A1 | 9/2016 | Howard et al. |
| 2016/0256561 A1 | 9/2016 | Howard et al. |
| 2016/0263239 A1 | 9/2016 | Howard et al. |
| 2016/0263242 A1 | 9/2016 | Howard et al. |
| 2016/0310611 A1 | 10/2016 | Flygare et al. |

FOREIGN PATENT DOCUMENTS

| | | |
|---|---|---|
| EP | 1295944 | 3/2003 |
| EP | 1347046 | 9/2003 |
| EP | 1394274 | 3/2004 |
| EP | 1439393 | 7/2004 |
| JP | 58180487 | 10/1983 |
| JP | 05003790 | 1/1993 |
| JP | 2004113151 | 4/2004 |
| WO | WO91/02536 | 3/1991 |
| WO | WO92/07574 | 5/1992 |
| WO | WO92/17497 | 10/1992 |
| WO | WO94/10312 | 5/1994 |
| WO | WO94/28931 | 12/1994 |
| WO | WO96/30514 | 10/1996 |
| WO | WO97/07198 | 2/1997 |
| WO | WO97/44452 | 11/1997 |
| WO | WO98/13059 | 4/1998 |
| WO | WO98/37193 | 8/1998 |
| WO | WO98/40403 | 9/1998 |
| WO | WO98/51805 | 11/1998 |
| WO | WO98/51824 | 11/1998 |
| WO | WO99/28468 | 6/1999 |
| WO | WO99/46284 | 9/1999 |
| WO | WO99/58658 | 11/1999 |
| WO | WO00/12130 | 3/2000 |
| WO | WO00/12507 | 3/2000 |
| WO | WO00/12508 | 3/2000 |
| WO | WO00/14228 | 3/2000 |
| WO | WO00/20579 | 4/2000 |
| WO | WO00/22129 | 4/2000 |
| WO | WO00/32752 | 6/2000 |
| WO | WO00/36107 | 6/2000 |
| WO | WO00/40614 | 7/2000 |
| WO | WO00/44899 | 8/2000 |
| WO | WO00/53216 | 9/2000 |
| WO | WO00/55351 | 9/2000 |
| WO | WO00/75655 | 12/2000 |
| WO | WO01/00244 | 1/2001 |
| WO | WO01/16318 | 3/2001 |
| WO | WO01/38490 | 5/2001 |
| WO | WO01/40269 | 6/2001 |
| WO | WO01/40309 | 6/2001 |
| WO | WO01/41787 | 6/2001 |
| WO | WO01/45746 | 6/2001 |
| WO | WO01/46232 | 6/2001 |
| WO | WO01/46261 | 6/2001 |
| WO | WO01/48204 | 7/2001 |
| WO | WO01/53463 | 7/2001 |

(56) References Cited

FOREIGN PATENT DOCUMENTS

| | | |
|---|---|---|
| WO | WO01/57188 | 8/2001 |
| WO | WO01/62794 | 8/2001 |
| WO | WO01/66689 | 9/2001 |
| WO | WO01/72830 | 10/2001 |
| WO | WO01/72962 | 10/2001 |
| WO | WO01/75177 | 10/2001 |
| WO | WO01/77172 | 10/2001 |
| WO | WO01/88133 | 11/2001 |
| WO | WO01/90304 | 11/2001 |
| WO | WO01/94641 | 12/2001 |
| WO | WO01/98351 | 12/2001 |
| WO | WO02/02587 | 1/2002 |
| WO | WO02/02624 | 1/2002 |
| WO | WO02/06317 | 1/2002 |
| WO | WO02/06339 | 1/2002 |
| WO | WO02/101075 | 1/2002 |
| WO | WO02/10187 | 2/2002 |
| WO | WO02/10382 | 2/2002 |
| WO | WO02/12341 | 2/2002 |
| WO | WO02/13847 | 2/2002 |
| WO | WO02/14503 | 2/2002 |
| WO | WO02/16413 | 2/2002 |
| WO | WO02/16429 | 2/2002 |
| WO | WO02/22153 | 3/2002 |
| WO | WO02/22636 | 3/2002 |
| WO | WO02/22660 | 3/2002 |
| WO | WO02/22808 | 3/2002 |
| WO | WO02/24909 | 3/2002 |
| WO | WO02/26822 | 4/2002 |
| WO | WO02/30268 | 4/2002 |
| WO | WO02/38766 | 5/2002 |
| WO | WO02/54940 | 7/2002 |
| WO | WO02/59377 | 8/2002 |
| WO | WO02/60317 | 8/2002 |
| WO | WO02/61087 | 8/2002 |
| WO | WO02/64798 | 8/2002 |
| WO | WO02/71928 | 9/2002 |
| WO | WO02/72596 | 9/2002 |
| WO | WO02/78524 | 10/2002 |
| WO | WO02/81646 | 10/2002 |
| WO | WO02/83866 | 10/2002 |
| WO | WO02/86443 | 10/2002 |
| WO | WO02/88170 | 11/2002 |
| WO | WO02/088172 | 11/2002 |
| WO | WO02/89747 | 11/2002 |
| WO | WO02/92836 | 11/2002 |
| WO | WO02/94852 | 11/2002 |
| WO | WO02/98358 | 12/2002 |
| WO | WO02/99074 | 12/2002 |
| WO | WO02/99122 | 12/2002 |
| WO | WO02/102235 | 12/2002 |
| WO | WO03/000842 | 1/2003 |
| WO | WO03/002717 | 1/2003 |
| WO | WO03/003906 | 1/2003 |
| WO | WO03/003984 | 1/2003 |
| WO | WO03/004529 | 1/2003 |
| WO | WO03/004989 | 1/2003 |
| WO | WO03/008537 | 1/2003 |
| WO | WO03/009814 | 2/2003 |
| WO | WO03/014294 | 2/2003 |
| WO | WO03/016475 | 2/2003 |
| WO | WO03/016494 | 2/2003 |
| WO | WO03/018621 | 3/2003 |
| WO | WO03/022995 | 3/2003 |
| WO | WO03/023013 | 3/2003 |
| WO | WO03/024392 | 3/2003 |
| WO | WO03/025138 | 3/2003 |
| WO | WO03/025148 | 3/2003 |
| WO | WO03/025228 | 3/2003 |
| WO | WO03/026493 | 4/2003 |
| WO | WO03/026577 | 4/2003 |
| WO | WO03/029262 | 4/2003 |
| WO | WO03/029277 | 4/2003 |
| WO | WO03/029421 | 4/2003 |
| WO | WO03/034984 | 5/2003 |
| WO | WO03/035846 | 5/2003 |
| WO | WO03/042661 | 5/2003 |
| WO | WO03/043583 | 5/2003 |
| WO | WO03/045422 | 6/2003 |
| WO | WO03/048202 | 6/2003 |
| WO | WO03/054152 | 7/2003 |
| WO | WO03/055439 | 7/2003 |
| WO | WO03/055443 | 7/2003 |
| WO | WO03/062401 | 7/2003 |
| WO | WO03/072035 | 9/2003 |
| WO | WO03/072036 | 9/2003 |
| WO | WO03/077836 | 9/2003 |
| WO | WO03/081210 | 10/2003 |
| WO | WO03/083041 | 10/2003 |
| WO | WO03/083047 | 10/2003 |
| WO | WO03/083074 | 10/2003 |
| WO | WO03/087306 | 10/2003 |
| WO | WO03/087768 | 10/2003 |
| WO | WO03/088808 | 10/2003 |
| WO | WO03/089624 | 10/2003 |
| WO | WO03/089904 | 10/2003 |
| WO | WO03/093444 | 11/2003 |
| WO | WO03/097803 | 11/2003 |
| WO | WO03/101283 | 12/2003 |
| WO | WO03/101400 | 12/2003 |
| WO | WO03/104270 | 12/2003 |
| WO | WO03/104275 | 12/2003 |
| WO | WO03/104399 | 12/2003 |
| WO | WO03/105758 | 12/2003 |
| WO | WO2004/000221 | 12/2003 |
| WO | WO2004/000997 | 12/2003 |
| WO | WO2004/001004 | 12/2003 |
| WO | WO2004/009622 | 1/2004 |
| WO | WO2004/011611 | 2/2004 |
| WO | WO2004/015426 | 2/2004 |
| WO | WO2004/016225 | 2/2004 |
| WO | WO2004/020583 | 3/2004 |
| WO | WO2004/020595 | 3/2004 |
| WO | WO2004/022709 | 3/2004 |
| WO | WO2004/022778 | 3/2004 |
| WO | WO2004/027049 | 4/2004 |
| WO | WO2004/031238 | 4/2004 |
| WO | WO2004/032828 | 4/2004 |
| WO | WO2004/032842 | 4/2004 |
| WO | WO2004/040000 | 5/2004 |
| WO | WO2004/042346 | 5/2004 |
| WO | WO2004/043361 | 5/2004 |
| WO | WO2004/043963 | 5/2004 |
| WO | WO2004/044178 | 5/2004 |
| WO | WO2004/045516 | 6/2004 |
| WO | WO2004/045520 | 6/2004 |
| WO | WO2004/045553 | 6/2004 |
| WO | WO2004/046342 | 6/2004 |
| WO | WO2004/047749 | 6/2004 |
| WO | WO2004/048938 | 6/2004 |
| WO | WO2004/053079 | 6/2004 |
| WO | WO2004/058309 | 7/2004 |
| WO | WO2004/063355 | 7/2004 |
| WO | WO2004/063362 | 7/2004 |
| WO | WO2004/063709 | 7/2004 |
| WO | WO2004/065576 | 8/2004 |
| WO | WO2004/065577 | 8/2004 |
| WO | WO2004/074320 | 9/2004 |
| WO | WO2005/023814 | 3/2005 |
| WO | WO2005/082023 | 9/2005 |
| WO | WO2005/085251 | 9/2005 |
| WO | WO2006/111759 | 10/2006 |
| WO | WO2007/044515 | 4/2007 |
| WO | WO2007/085930 | 8/2007 |
| WO | WO2009/052249 | 4/2009 |
| WO | WO2010/091150 | 8/2010 |
| WO | WO2014/057074 | 4/2014 |
| WO | WO2014/057115 | 4/2014 |

(56) References Cited

FOREIGN PATENT DOCUMENTS

| WO | WO2014/140174 | 9/2014 |
|---|---|---|
| WO | WO2016/038383 | 3/2016 |

OTHER PUBLICATIONS

Amir et al., "Self-Immolative Dendrimers," Angew. Chem. Int. Ed. 2003, 42, 4494-4499.

Amsberry et al., "The Lactonization of 2'-Hydroxyhydrocinnamic Acid Amides: A Potential Prodrug for Amines," J. Org. Chem. 1990, 55, 5867-5877.

Arai et al., "Molecular cloning of human endothelin receptors and their expression in vascular endothelial cells and smooth muscle cells," Jpn. Circ. J. 1992, 56, 1303-1307.

Arai et al., "The Human Endothelin-B Receptor Gene," J. Biol. Chem. 1993, 268, 3463-3470.

Arima et al., "Studies on Tomaymycin, a New Antibiotic. I. Isolation and Properties of Tomaymycin," J. Antibiotics (1972) 25:437-444.

Attié et al., "Mutation of the endothelin-receptor B gene in Waardenburg-Hirschsprung disease," Hum. Mol. Genet. 1995, 4, 2407-2409.

Auricchio et al., "Endothelin-B receptor mutations in patients with isolated Hirschsprung disease from a non-inbred population," Hum. Mol. Genet. 1996, 5, 351-354.

Bahrenberg et al., "Reduced Expression of PSCA, a Member of the LY-6 Family of Cell Surface Antigens, in Bladder, Esophagus, and Stomach Tumors," Biochem. Biophys. Res. Commun. 2000, 275, 783-788.

Barel et al., "Evidence for a new transcript of the Epstein-Barr virus/C3d receptor (CR2, CD21) which is due to alternative exon usage," Mol. Immunol. 1998, 35, 1025-1031.

Barella et al., "Sequence variation of a novel heptahelical leucocyte receptor through alternative transcript formation," Biochem. J. 1995, 309, 773-779.

Barnett et al., "Carcinoembryonic Antigen Family: Characterization of cDNAs Coding for NCA and CEA and Suggestion of Nonrandom Sequence Variation in Their Conserved Loop-Domains," Genomics 1988, 3, 59-66.

Beck et al., "DNA Sequence Analysis of 66 kb of the Human MHC Class II Region Encoding a Cluster of Genes for Antigen Processing," J. Mol. Biol. 1992, 228, 433-441.

Beck et al., "Evolutionary Dynamics of Non-coding Sequences Within the Class II Region of the Human MHC," J. Mol. Biol. 1996, 255, 1-13.

Berge et al., "Pharmaceutical Salts," J. Pharm. Sci. 1977, 66, 1-19.

Blumberg et al., "Interleukin 20: Discovery, Receptor Identification, and Role in Epidermal Function," Cell 2001, 104, 9-19.

Bose et al., "New Approaches to Pyrrolo[2,1-c][1,4]benzodiazepines: Synthesis, DNA-binding and cytotoxicity of DC-81," Tetrahedron 1992, 48, 751-758.

Bourgeois et al., "Endothelin-1 and ETA Receptor Expression in Vascular Smooth Muscle Cells from Human Placenta: A New ETA Receptor Messenger Ribonucleic Acid Is Generated by Alternative Splicing of Exon 3," J. Clin. Endocrinol. Metab. 1997, 82, 3116-3123.

Brinster et al., "Introits increase transcriptional efficiency in transgenic mice," Proc. Natl. Acad. Sci. USA 1988, 85, 836-840.

Buchman et al., "Comparison of Intron-Dependent and Intron-Independent Gene Expression," Mol. Cell. Biol. 1988, 8, 4395-4405.

Carl et al., "A Novel Connector Linkage Applicable in Prodrug Design," J. Med. Chem. 1981, 24, 479-480.

Carlsson et al., "Protein Thiolation and Reversible Protein-Protein Conjugation," Biochem. J. 1978, 173, 723-737.

Carter, "Potent antibody therapeutics by design," Nat. Rev. Immunol. 2006, 6, 343-357.

CellTiter Glo Luminescent Cell Viability Assay, Promega Corp. Technical Bulletin TB288, dated Jan. 13, 2012 (14 pages).

Chakravarty et al., "Plasmin-Activated Prodrugs for Cancer Chemotherapy. 2. Synthesis and Biological Activity of Peptidyl Derivatives of Doxorubicin," J. Med. Chem. 1983, 26, 638-644.

Chan et al., "eek and erk, new members of the eph subclass of receptor protein-tyrosine kinases," Oncogene 1991, 6, 1057-1061.

Chang et al., "Molecular cloning of mesothelin, a differentiation antigen present on mesothelium, mesotheliomas, and ovarian cancers," Proc. Natl. Acad. Sci. USA 1996, 93, 136-140.

Child et al., "Translational Control by an Upstream Open Reading Frame in the HER-2/neu Transcript," J. Biol. Chem. 1999, 274, 24335-24341.

Cho et al., "Structure of the extracellular region of HER2 alone and in complex with the Herceptin Fab," Nature 2003, 421, 756-760.

Ciccodicola et al., "Molecular characterization of a gene of the 'EGF family' expressed in undifferentiated human NTERA2 teratocarcinoma cells," EMBO J. 1989, 8, 1987-1991.

Clackson et al., "Making antibody fragments using phage display libraries," Nature 1991, 352, 624-628.

Clark et al., "The Secreted Protein Discovery Initiative (SPDI], a Large-Scale Effort to Identify Novel Human Secreted and Transmembrane Proteins: A Bioinformatics Assessment," Genome Res. 2003, 13, 2265-2270.

Corey et al., "LuCap35: a new model of prostate cancer progression to androgen independence." The Prostate 2003, 55, 239-246.

Coussens et al., "Tyrosine Kinase Receptor with Extensive Homology to EGF Receptor Shares Chromosomal Location With neu Oncogene," Science 1985, 230, 1132-1139.

Cragg et al., "The alternative transcript of CD79b is overexpressed in B-CLL and inhibits signaling for apoptosis," Blood 2002, 100, 3068-3076.

Cree et al., "Methotrexate chemosensitivity by ATP luminescence in human leukemia cell lines and in breast cancer primary cultures: comparison of the TCA-100 assay with a clonogenic assay," Anti-cancer Drugs 1995, 6, 398-404.

Crouch et al., "The use of ATP bioluminescence as a measure of cell proliferation and cytotoxicity," J. Immunol. Meth. 1993, 160, 81-88.

Davis et al., "Identification of a family of Fc receptor homo logs with preferential B cell expression," Proc. Natl. Acad. Sci USA 2001, 98, 9772-9777.

de Groot et al., "Cascade-Release Dendrimers" Liberate All End Groups upon a Single Triggering Event in the Dendritic Core, Angew. Chem. Int. Ed. 2003, 42, 4490-4494.

de Groot et al., "Elongated Multiple Electronic Cascade and Cyclization Spacer Systems in Activatible Anticancer Prodrug for Enhanced Drug Release," J. Org. Chem. 2001, 66, 8815-8830.

Dennis et al., "Albumin Binding As a General Strategy for Improving the Pharmacokinetics of Proteins" J. Biol. Chem. 2002, 277, 35035-35043.

Dobner et al. "Differentiation-specific expression of a novel G protein-coupled receptor from Burkitt's lymphoma," Eur. J. Immunol. 1992, 22, 2795-2799.

Dono et al., "Isolation and Characterization of the CRI PTO Autosomal Gene and Its X-linked Related Sequence," Am. J. Hum. Genet. 1991, 49, 555-565.

Dornan et al., "Therapeutic potential of an anti-CD79b antibody-drug conjugate, anti-CD79b-vc-MMAE, for the treatment of non-Hodgkin lymphoma," Blood 2009, 114, 2721-2729.

Doronina et al., "Enhanced Activity of Monomethylauristatin F through Monoclonal Antibody Delivery: Effects of Linker Technology on Efficacy and Toxicity," Bioconj. Chem. 2006, 17, 114-124.

Dubowchik et al., "Cathepsin B-Labile Dipeptide Linkers for Lysosomal Release of Doxorubicin from Internalizing Immunoconjugates: Model Studies of Enzymatic Drug Release and Antigen-Specific In Vitro Anticancer Activity," Bioconj. Chem. 2002, 13, 855-869.

Dubowchik et al., "Monomethoxytrityl (MMT) as a Versatile Amino Protecting Group for Complex Prodrugs of Anticancer Compounds Sensitive to Strong Acids, Bases and Nucleophiles," Tetrahedron Lett. 1997, 38, 5257-5260.

Dumoutier et al., "Cutting Edge: STAT Activation by IL-19, IL-20 and mda-7 Through IL-20 Receptor Complexes of Two Types," J. Immunol. 2001, 167, 3545-3549.

(56) References Cited

OTHER PUBLICATIONS

Ehsani et al., "Characterization of a New Allele of the Human ERBB2 Gene by Allele-Specific Competition Hybridization," Genomics 1993, 15, 426-429.
Eliel et al., Stereochemistry of Organic Compounds, John Wiley & Sons, Inc., New York (1994).
Elshourbagy et al., "Molecular Characterization and Regulation of the Human Endothelin Receptors," J. Biol. Chem. 1993, 268, 3873-3879.
Erickson et al., "Antibody-Maytansinoid Conjugates Are Activated in Targeted Cancer Cells by Lysosomal Degradation and Linker-Dependent Intracellular Processing," Cancer Res. 2006, 66, 4426-4433.
Feild et al., "Cloning and Functional Characterization of a Sodium-Dependent Phosphate Transporter Expressed in Human Lung and Small Intestine," Biochem. Biophys. Res. Commun. 1999, 258, 578-582.
Fields et al., "Solid phase peptide synthesis utilizing 9-fluoroenylmethoxycarbonyl amino acids", Int. J. Peptide Protein Res. 1990, 35, 161-214.
Flanagan et al., "The Ephrins and EPH Receptors in Neural Development," Annu. Rev. Neurosci. 1998, 21, 309-345.
Fox et al., "cDNA cloning and tissue distribution of five human EPH-like receptor protein-tyrosine kinases," Oncogene 1995, 10, 897-905.
Fuchs et al., "Functional Characterization of Three Mutations of the Endothelin B Receptor Gene in Patients With Hirschsprung's Disease: Evidence for Selective Loss of Gi Coupling," Mol. Med. 2001, 7, 115-124.
Fujisaku et al., "Genomic Organization and Polymorphisms of the Human C3d/Epstein-Barr Virus Receptor," J. Biol. Chem. 1989, 264, 2118-2125.
Gary et al., "cDNA cloning chromosomal localization, and expression analysis of human BEHAB/brevican, a brain specific proteoglycan regulated during cortical development and in glioma," Gene 2000, 256, 139-147.
Gaugitsch et al., "A Novel Transiently Expressed, Integral Membrane Protein Linked to Cell Activation. Molecular Cloning Via the Rapid Degradation Signal AUUUA," J. Biol. Chem. 1992, 267, 11267-11273.
Geiser et al., "Automation of solid-phase peptide synthesis" in Macromolecular Sequencing and Synthesis, Alan R. Liss, Inc., 1988, pp. 199-218.
Geoghegan et al., "Site-Directed Conjugation of Nonpeptide Groups to Peptides and Proteins via Periodate Oxidation of a 2-Amino Alcohol. Application to Modification at N-Terminal Serine," Bioconj. Chem. 1992, 3, 138-146.
Getz et al., "A Comparison between the Sulfhydryl Reductants Tris(2-carboxyethyl)phosphine and Dithiothreitol for Use in Protein Biochemistry," Anal. Biochem. 1999, 273, 73-80.
Glynne-Jones et al., "TENB2, A Proteogl YCAN Identified in Prostate Cancer That Is Associated With Disease Progression and Androgen Independence," Int. J. Cancer 2001, 94, 178-184.
Gordon et al., "Somatic hypermutation of the B cell receptor genes 829 (Igf3, CD79b) and mb1 (Iga, CD79a)," Proc. Natl. Acad. Sci. USA 2003, 100, 4126-4131.
Gregson et al., "Linker length modulates DNA cross-linking reactivity and cytotoxic potency of C8/C8' ether-linked C2-exo-unsaturated pyrrolo[2,1-c][1,4]benzodiazepine (PBD) dimers," J. Med. Chem. 2001, 44, 1161-1174.
Gregson et al., "Synthesis of a novel C2/C2'-exo unsaturated pyrrolobenzodiazepine cross-linking agent with remarkable DNA binding affinity and cytotoxicity," Chem. Commun. 1999, 797-798.
Gu et al., "Prostate stem cell antigen (PSCA) expression increases with high gleason score, advanced stage and bone metastasis in prostate cancer," Oncogene 2000, 19, 1288-1296.
Guselnikov et al., "A family of highly diverse human and mouse genes structurally links leukocyte FcR, gp42 and PECAM-1," Immunogenetics 2002, 54, 87-95.
Ha et al., "Molecular Cloning and Expression Pattern of a Human Gene Homologous to the Murine mb-1 Gene," J. Immunol. 1992, 148, 1526-1531.
Haendler et al., "Molecular Cloning of Human Endothelin (ET) Receptors ETA and ETB," J. Cardiovasc. Pharmacol. 1992, 20, s1-s4.
Hamann, "Monoclonal antibody-drug conjugates," Expert Opin. Ther. Patents 2005, 15, 1087-1103.
Hamblett et al., "Effects of Drug Loading on the Antitumor Activity of a Monoclonal Antibody Drug Conjugate," Clin. Cancer Res. 2004, 10, 7063-7070.
Handbook of Pharmaceutical Additives, 2nd Ed. (eds. M. Ash and I. Ash), Synapse Information Resources, Inc., Endicott, New York, USA (2001).
Handbook of Pharmaceutical Excipients, 2nd edition, 1994.
Hara et al., "DC 102, a new glycosidic pyrrolo(1,4)benzodiazepine antibiotic produced by *streptomyces* sp.," J. Antibiotics 1988, 41, 702-704.
Hashimoto et al., "Chromosomal localization, genomic structure, and allelic polymorphism of the human CD79a (lg-alpha/mb-1) gene," Immunogenetics 1994, 40, 287-295.
Hay et al., "A 2-Nitro Imidazole Carbamate Prodrug of 5-Amino-1-(Chloromethyl)-3-[(5,6,7-Trimethoxyindol-2-Yl)Carbonyl]-1,2-Dihydro-3H-Benz[E]Indole (Amino-Seco-CBI-TMI) for Use With ADEPT and GDEPT," Bioorg. Med. Chem. Lett. 1999, 9, 2237-2242.
Herdwijn et al., "Synthesis of trans(+ )6-phenoxyacetamido-1-methylene-3,3-dicarboxymethyl-1-carbapenam," Can. J. Chem. 1982, 60, 2903-2907.
Hermanson, "Heterobifunctional Cross-linkers," Bioconjugate Techniques; Academic Press: New York, pp. 234-242 (1996).
Hochlowski et al., "Abbeymycin, a new anthramycin-type antibiotic produced by a streptomycete," J. Antibiotics 1987, 40, 145-148.
Hofstra et al., "A homozygous mUtation in the endothelin-3 gene associated with a combined Waardenburg type 2 and Hirschsprung phenotype (Shah-Waardenburg syndrome)," Eur. J. Hum. Genet. 1997, 5, 180-185.
Hofstra et al., "Mutations in Hirschsprung Disease: When Does a Mutation Contribute to the Phenotype," Nat. Genet. 1996, 12, 445-447.
Horie et al., "Identification and Characterization of TMEFF2, a Novel Surviv Factor for Hippocampal and Mesencephalic Neurons," Genomics 2000, 67, 146-152.
Hubert et al., "STEAP: A prostate-specific cell-surface antigen highly expressed in human prostate tumors," Proc. Natl. Acad. Sci. U.S.A. 1999, 96, 14523-14528.
Hurley et al., "Covalent Binding of Antitumor Antibiotics in the Minor Groove of DNA. Mechanism of Action of CC-1065 and the Pyrrolo(1,4)benzodiazepines," Acc. Chem. Res. 1986, 19, 230-237.
Ide et al., "Cloning of human bone morphogenetic protein type IB receptor (BMPRIB) and its expression in prostate cancer in comparison with other BMPRs," Oncogene 1997, 14, 1377-1382.
International Search Report and Written Opinion for Application No. PCT/EP2014/069248 dated Jan. 6, 2015 (10 pages).
Itoh et al., "Sibanomicin, a new pyrrolo(1,4)benzodiazepine antitumor antibiotic produced by a *micromonospora* sp.," J. Antibiotics 1988, 41, 1281-1284.
Janeway et al., Immuno Biology, 5th Ed., Garland Publishing, New York (2001).
Jeffrey et al., "Design, synthesis, and in vitro evaluation of dipeptide-based antibody minor groove binder conjugates," J. Med. Chem. 2005, 48, 1344-1358.
Jonsson et al., "Human class II DNA and DOB genes display low sequence variability," Immunogenetics 1989, 29, 411-413.
Junutula et al., "Site-specific conjugation of a cytotoxic drug to an antibody improves the therapeutic index," Nature Biotech. 2008, 26, 925-932.
Kamal et al., "Recent Developments in the Design, Synthesis and Structure-Activity Relationship Studies of Pyrrolo[2,1-C][1,4]benzodiazepines as DNA-interactive Antitumour Antibiotics," Curr. Med. Chem. Anticancer Agents 2002, 2, 215-254.

(56) References Cited

OTHER PUBLICATIONS

Kang et al., "Synthesis of a novel C2-aryl substituted 1,2-unsaturated pyrrolobenzodiazepine," Chem. Commun. 2003, 1680-1689.
Kasahara et al., "Nucleotide sequence of a chimpanzee DOB eDNA clone," Immunogenetics 1989, 30, 66-68.
King et al., "Facile synthesis of maleimide bifunctional Jinkers," Tetrahedron Letters 2002, 43, 1987-1990.
Kingsbury et al., "A Novel Peptide Delivery System Involving Peptidase Activated Prodrugs as Antimicrobial Agents. Synthesis and Biological Activity of Peptidyl Derivatives of 5 Fluorouracil," J. Med. Chem. 1984, 27, 1447-1451.
Kohler et al., "Continuous cultures of fused cells secreting antibody of predefined specificity," Nature 1975, 256, 495-497.
Kohn, "Anthramycin," Antibiotics III, Springer-Verlag, New York, pp. 3-11 (1975).
Kojima et al., "Molecular Cloning and Expression of Megakaryocyte Potentiating Factor eDNA," J. Biol. Chem. 1995, 270, 21984-21990.
Konishi et al., "Chicamycin, a new antitumor antibiotic II. Structure determination of chicamycins A and B," J. Antibiotics 1984, 37, 200-206.
Kovtun et al., "Antibody-Drug Conjugates Designed to Eradicate Tumors with Homogeneous and Heterogeneous Expression of the Target Antigen," Cancer Res. 2006, 66, 3214-3121.
Kuhns et al., "Poor Binding of a HER-2/neu Epitope (GP2) to HLA-A2.1 Is due to a Lack of Interactions with the Center of the Peptide," J. Biol. Chem. 1999, 274, 36422-36427.
Kuminoto et al., "Mazethramycin, a new member of anthramycin group antibiotics," J. Antibiotics 1980, 33, 665-667.
Kurebayashi et al., "Isolation and characterization of a new human breast cancer cell line, KPL-4, expressing the Erb B family receptors and interleukin 6," Brit. Jour. Cancer 1999, 79, 707-717.
Lambert, "Drug-conjugated monoclonal antibodies for the treatment of cancer," Current Opin. in Pharmacol. 2005, 5, 543-549.
Langley et al., "A versatile and efficient synthesis of carbinolamine-containing pyrrolo[1,4]benzodiazepines via the cyclization of N-92-aminobenzoyl)pyrrolidine-2-carboxaldehyde diethyl thioacetals: total synthesis of prothracarcin," J. Org. Chem. 1987, 52, 91-97.
Larhammar et al., "Sequence of Gene and eDNA Encoding Murine Major Histocompatibility Complex Class II Gene AP2*," J. Biol. Chem. 1985, 260, 14111-14119.
Launay et al., "TRPM4 Is a Ca2+-Activated Nonselective Cation Channel Mediating Cell Membrane Depolarization," Cell 2002, 109, 397-407.
Law et al., "Lymphocyte Activation Antigen CD70 Expressed by Renal Cell Carcinoma Is a Potential Therapeutic Target for Anti-CD70 Antibody-Drug Conjugates," Cancer Res. 2006, 66, 2328-2337.
Le et al., "Primary structure and expression of a naturally truncated human P2X ATP receptor subunit from brain and immune system," FEBS Lett. 1997, 418, 195-199.
Leber et al., "A revised structure for sibiromycin," J. Am. Chem. Soc. 1988, 110, 2992-2993.
Leimgruber et al., "Isolation and Characterization of Anthramycin, a New Antitumor Antibiotic," J. Am. Chem. Soc. 1965, 87, 5793-5795.
Leimgruber et al., "The Structure of Anthramycin," J. Am. Chem. Soc. 1965, 87, 5791-5793.
Levenson et al., "MCF-7: The First Hormone-responsive Breast Cancer Cell Line," Cancer Res. 1997, 57, 3071-3078.
Liang et al., "The Gene for a Novel Transmembrane Protein Containing Epidermal Growth Factor and Follistatin Domains Is Frequently Hypermethylated in Human Tumor Cells," Cancer Res. 2000, 60, 4907-12.
Manfré et al., "Syntheses of Proline Analogues as Potential Mechanism-Based Inhibitors of Proline Dehydrogenase: 4-Methylene-L-, (E)- and (Z)-4-(Fluoromethylene)-L-, cis- and trans-5-Ethynyl-($\pm$)-, and cis- and trans -5-Vinyl-L-proline," J. Org. Chem. 1992, 57, 2060-2065.

Marks et al., "By-passing Immunization, Human Antibodies from V-gene Libraries Displayed on Phage," J. Mol. Biol. 1991, 222, 581-597.
Mastroberardino et al., "Amino-acid transport by heterodimers of 4F2hc/CD98 and members of a permease family," Nature 1998, 395, 288-291.
McDonagh, "Engineered antibody-drug conjugates with defined sites and stoichiometries of drug attachment," Protein Eng. Design & Sel. 2006, 19, 299-307.
Mendoza et al., "Inhibition of Ligand-mediated HER2 Activation in Androgen-independent Prostate Cancer," Cancer Res. 2002, 62, 5485-5488.
MGC Program Team, Proc. Natl. Acad. Sci. USA 2002, 99, 16899-16903.
Miller et al., "Design, Construction, and In Vitro Analyses of Multivalent Antibodies," J. Immunol. 2003, 170, 4854-4861.
Miller et al., "IRTAs: a new family of immunoglobulinlike receptors differentially expressed in B cells," Blood 2002, 99, 2662-2669.
Miura et al., "RPIOS Is Associated With MD-1 and Transmits an Activation Signal in Human B Cells," Blood 1998, 92, 2815-2822.
Miura et al., "RPIOS Is Associated With MD-1 and Transmits an Activation Signal in Human B Cells," Genomics 1996, 38, 299-304.
Moore et al., "Molecular cloning of the eDNA encoding the Epstein-Barr virus/C3d receptor (complement receptor type 2) of human B lymphocytes," Proc. Natl. Acad. Sci. USA 1987, 84, 9194-9198.
Morrison et al., "Chimeric human antibody molecules: Mouse antigen-binding domains with human constant region domains," Proc. Natl. Acad. Sci. USA 1984, 81, 6851-6855.
Muller et al., "Cloning and sequencing of the eDNA encoding the human homologue of the murine immunoglobulin-associated protein B29," Eur. J. Immunol. 1992, 22, 1621-1625.
Mungall et al., "The DNA sequence and analysis of human chromosome 6," Nature 2003, 425, 805-811.
Nagase et al., "Prediction of the Coding Sequences of Unidentified Human Genes. XVII. The Complete Sequences of 100 New eDNA Clones from Brain Which Code for Large Proteins in vitro," DNA Res. 2000, 7, 143-150.
Nakamuta et al., "Cloning and Sequence Analysis of a cDNA Encoding Human Non-Selective Type of Endothelin Receptor," Biochem. Biophys. Res. Commun. 1991, 177, 34-39.
Nakayama et al., "Altered Gene Expression upon BCR Cross-Linking in Burkitt's Lymphoma B Cell Line," Biochem. Biophys. Res. Commun. 2000, 277, 124-127.
Naruse et al., "The HLA-DOB gene displays limited polymorphism with only one amino acid substitution," Tissue Antigens 2002, 59, 512-519.
Neuberger et al., "The intron requirement for immunoglobulin gene expression is dependent upon the promoter," Nucleic Acids Res. 1988, 16, 6713-6724.
Nicolaou et al., "Calicheamicin 01: A Rationally Designed Molecule with Extremely Potent and Selective DNA Cleaving Properties and Apoptosis Inducing Activity," Angew. Chem. Int. Ed. Engl. 1994, 33, 183-186.
Nilius et al., "Voltage Dependence of the Ca2+ -activated Cation Channel TRPM4," J. Biol. Chem. 2003, 278, 30813-30820.
Ogawa et al., "Molecular Cloning of a Non-Isopeptide-Selective Human Endothelin Receptor," Biochem. Biophys. Res. Commun. 1991, 178, 248-255.
Okamoto et al., "Palmitoylation of Human EndothelinB," Biol. Chem. 1997, 272, 21589-21596.
Parrish-Novak et al., "Interleukins 19, 20, and 24 Signal through Two Distinct Receptor Complexes," J. Biol. Chem. 2002, 277, 47517-47523.
Payne, "Progress in immunoconjugate cancer therapeutics," Cancer Cell 2003, 3, 207-212.
Phillips et al., "Targeting HER2-Positive Breast Cancer with Trastuzumab-DM1, an Antibody-Cytotoxic Drug Conjugate," Cancer Res. 2008, 68, 9280-9290.
Pingault et al., "SOX10 mutations in chronic intestinal pseudo-obstruction suggest a complex physiopathological mechanism," Hum. Genet. 2002, 111, 198-206.

(56) References Cited

OTHER PUBLICATIONS

Pletnev et al., "Characterization of the Recombinant Extracellular Domains of Human Interleukin-20 Receptors and Their Complexe with Interleukin-19 and Interleukin-20," Biochemistry 2003, 42, 12617-12624.
Porkka et al., "Cloning and Characterization of a Novel Six-Transmembrane Protein STEAP2, Expressed in Normal and Malignant Prostate," Lab. Invest. 2002, 82, 1573-1582.
Prasad et al., "Human LAT1, a Subunit of System L Amino Acid Transporter: Molecular Cloning and Transport Function," Biochem. Biophys. Res. Commun. 1999, 255, 283-288.
Preud'homme et al., "Structure and expression of the mb-1 transcript in human lymphoid cells," Clin. Exp. Immunol. 1992, 90, 141-146.
Protective Groups in Organic Synthesis, Greene and Wuts, 3rd Ed., John Wiley & Sons Inc. (1999).
Puffenberger et al., "A Missense Mutation of the Endothelin-B Receptor Gene in Multigenic Hirschsprung's Disease," Cell 1994, 79, 1257-1266.
Rao et al., "Influence of diet on mammary cancer in transgenic mice bearing an oncogene expressed in mammary tissue," Breast Cancer Res. Treat. 1997, 45, 149-158.
Reiter et al., "Prostate stem cell antigen: A cell surface marker overexpressed in prostate cancer," Proc. Natl. Acad. Sci. USA 1998, 95, 1735-1740.
Rodrigues et al., "Synthesis and beta-lactamase-mediated activation of a cephalosporin-taxol prodrug," Chem. Biol. 1995, 2, 223-227.
Ross et al., "Prostate Stem Cell Antigen as Therapy Target: Tissue Expression and in Vivo Efficacy of an Immunoconjugate," Cancer Res. 2002, 62, 2546-2553.
Sakaguchi et al., "8 lymphocyte lineage-restricted expression of mb-1, a gene with CD3-like structural properties," EMBO J. 1988, 7, 3457-3464.
Sakamoto et al., "Cloning and Functional Expression of Human cDNA for the ETB Endothelin Receptor," Biochem. Biophys. Res. Commun. 1991, 178, 656-663.
Sanderson et al., "In vivo Drug-Linker Stability of an Anti-CD30 Dipeptide-Linked Auristatin Immunoconjugate," Clin. Cancer Res. 2005, 11, 843-852.
Scholler et al., "Soluble member(s) of the mesothelin/ megakaryocyte potentiating factor family are detectable in sera from patients with ovarian carcinoma," Proc. Natl. Acad. Sci. USA 1999, 96, 11531-11536.
Schröder et al., The Peptides, vol. 1, pp. 76-136, Academic Press (1965).
Segawa et al., "Growth-related Renal Type II Na/Pi Cotransporter," J. Biol. Chem. 2002, 277, 19665-19672.
Semba et al., "A v-erbB-related protooncogene, c-erbB-2, is distinct from the c-erbB-1 /epidermal growth factor-receptor gene and is amplified in a human salivary gland adenocarcinoma," Proc. Natl. Acad. Sci. USA 1985, 82, 6497-6501.
Servenius et al., "Class II Genes of the Human Major Histocompatibility Complex, The DOBeta Gene Is a Divergent Member of the Class II P Gene Family," J. Biol. Chem. 1987, 262, 8759-8766.
Shamis et al., "Bioactivation of Self-lmmolative Dendritic Prodrugs by Catalytic Antibody 38C2," J. Am. Chem. Soc. 2004, 126, 1726-1731.
Sheikh et al., "Cutting Edge: IL-26 Signals through a Novel Receptor Complex Composed of IL-20 Receptor 1 and IL-10 Receptor 21," J. Immunol. 2004, 172, 2006-2010.
Shimizu et al., "Prothracarcin, a novel antitumor antibiotic," J. Antibiotics 1982, 29, 2492-2503.
Sinha et al., "Characterization of the EBV /C3d Receptor on the Human Jurkat T Cell Line: Evidence for a Novel Transcript," J. Immunol. 1993, 150, 5311-5320.
Storm et al, "Effect of Small Changes in Orientation on Reaction Rate," J. Am. Chem. Soc. 1972, 94, 5815-5825.
Strausberg et al., "Generation and initial analysis of more than 15,000 full-length human and mouse eDNA sequences," Proc. Natl. Acad. Sci. USA 2002, 99, 16899-16903.
Sun et al., "Enabling ScFvs as Multi-Drug Carriers: A Dendritic Approach," Bioorg. Med. Chem. 2003, 11, 1761-1768.
Sun et al., "Syntheses of Dendritic Linkers Containing Chlorambucil Residues for the Preparation of Antibody-Multidrug Immunoconjugates," Bioorg. Med. Chem. Lett. 2002, 12, 2213-2215.
Svensson et al., "Phenotypic variation in a family with mutations in two Hirschsprung-related genes (RET and endothelin receptor B)," Hum. Genet. 1998, 103, 145-148.
Swiercz et al., "Plexin-81 /RhoGEF-mediated Rho A activation involves the receptor tyrosine kinase ErbB-2," J. Cell Biol. 2004, 165, 869-880.
Syrigos et al., "Antibody Directed Enzyme Prodrug Therapy (ADEPT): A Review of the Experimental and Clinical Considerations," Anticancer Res. 1999, 19, 605-614.
Takeuchi et al., "Neothramycins A and B, New Antitumor Antibiotics," J. Antibiotics 1976, 29, 93-96.
Tawaragi et al., "Primary Structure of Nonspecific Crossreacting Antigen (NCA), A Member of Carcinoembryonic Antigen (CEA) Gene Family, Deduced From cDNA Sequence," Biochem. Biophys. Res. Commun. 1988, 150, 89-96.
Ten Dijke et al., "Characterization of type I receptors for transforming growth factor-beta and activin," Science 1994, 264, 101-104.
Thompson et al., "BAFF-R, a Newly Identified TNF Receptor That Specifically Interacts with BAFF," Science 2001, 293, 2108-2111.
Thurston et al., "The molecular recognition of DNA," Chem. Brit. 1990, 26, 767-772.
Thurston, et al., "Synthesis of DNA-Interactive Pyrrolo[2,1-c][1,4]benzodiazepines," Chem. Rev. 1994, 433-465.
Toki et al., "Protease-Mediated Fragmentation of p-Amidobenzyl Ethers: A New Strategy for the Activation of Anticancer Prodrugs," J. Org. Chem. 2002, 67, 1866-1872.
Tonnelle et al., "DOBeta a new chain gene in HLA-D with a distinct regulation of expression," EMBO J. 1985, 4, 2839-2847.
Touchman et al., "The Genomic Region Encompassing the Nephropathic Cystinosis Gene (CTNS): Complete Sequencing of a 200-kb Segment and Discovery of a Novel Gene within the Common Cystinosis-Causing Deletion," Genome Res. 2000, 10, 165-173.
Trail et al., "Monoclonal antibody drug immunoconjugates for targeted treatment of cancer," Cancer Immunol. Immunother. 2003, 52, 328-337.
Tsunakawa et al., "Porothramycin, a new antibiotic of the anthramycin group: Production, isolation, structure and biological activity," J. Antibiotics 1988, 41, 1366-1373.
Tsutsumi et al., "Novel endothelin B receptor transcripts with the potential of generating a new receptor," Gene 1999, 228, 43-49.
Uchida et al., "A Novel Epidermal Growth Factor-like Molecule Containing Two Follistatin Modules Stimulates Tyrosine Phosphorylation of erbB-4 in MKN28 Gastric Cancer Cells," Biochem. Biophys. Res. Commun. 1999, 266, 593-602.
Verheij et al., "ABCD Syndrome Is Caused by a Homozygous Mutation in the EDNRB Gene," Am. J. Med. Genet. 2002, 108, 223-225.
Von Hoegen et al., "Identifigation of a Human Protein Homologous to the Mouse Lyb-2 B Cell Differentiation Antigen and Sequence of the Corresponding cDNA," J. Immunol. 1990, 144, 4870-4877.
Webster et al., "Mammary tumorigenesis and metastasis in transgenic mice," Semin. Cancer Biol. 1994, 5, 69-76.
Weis et al., "Identification of a partial eDNA clone for the C3d/ Epstein-Barr virus receptor of human B lymphocytes: Homology with the receptor for fragments C3b and C4b of the third and fourth components of complement," Proc. Natl. Acad. Sci. USA 1986, 83, 5639-5643.
Weis et al., "Structure of the Human B Lymphocyte Receptor for C3d and the Epstein-Barr Virus and Relatedness to Other Members of the Family of C3/C4 Binding Proteins," J. Exp. Med. 1988, 167, 1047-1066.
Wilkinson, "Eph Receptors and Ephrins: Regulators of Guidance and Assembly," Int. Rev. Cytol. 2000, 196, 177-244.
Wilson et al., "eDNA Cloning of the B Cell Membrane Protein CD22: A Mediator of B—B Cell Interactions," J. Exp. Med. 1991, 173, 137-146.

(56) References Cited

OTHER PUBLICATIONS

Wu et al., "Arming antibodies: prospects and challenges for immunoconjugates," Nature Biotech. 2005, 23, 1137-1145.
Xie et al., "In vivo behaviour of antibody—drug conjugates for the targeted treatment of cancer," Expert. Opin. Biol. Ther. 2006, 6, 281-291.
Xu et al., "Molecular Cloning and Characterization of SPAP1, an Inhibitory Receptor," Proc. Natl. Acad. Sci. USA 2001, 98, 10692-10697.
Xu et al., "Molecular Cloning, Functional Characterization, Tissue Distribution, and Chromosomal Localization of a Human, Small Intestinal Sodium-Phosphate (Na + −Pi) Transporter (SLC34A2)," Genomics 1999, 62, 281-284.
Xu et al., Biochem. Biophys. Res. Commun. 2001, 280, 768-775.
Yamaguchi et al., "A Novel Cytokine Exhibiting Megakaryocyte Potentiating Activity From a Human Pancreatic Tumor Cell Line HPC-Y5," Biol. Chem. 1994, 269, 805-808.
Yamamoto et al., "Similarity of protein encoded by the human c-erb-B-2 gene to epidermal growth factor receptor," Nature 1986, 319, 230-234.
Yang et al., "Murine Six-Transmembrane Epithelial Antigen of the Prostate, Prostate Stem Cell Antigen, and Prostate-specific Membrane Antigen: Prostate-specific Cell-Surface Antigens Highly Expressed in Prostate Cancer of Transgenic Adenocarcinoma Mouse Prostate Mice," Cancer Res. 2001, 61, 5857-5860.
Yin et al., "Molecular Cloning of the CA125 Ovarian Cancer Antigen," J. Biol. Chem. 2001, 276, 27371-27375.
Yu et al., "Human mb-1 Gene: Complete eDNA Sequence and Its Expression in B Cells Bearing Membrane Ig of Various Isotypes," J. Immunol. 1992, 148, 633-637.

\* cited by examiner

PYRROLOBENZODIAZEPINES AND CONJUGATES THEREOF

The present invention relates to pyrrolobenzodiazepines (PBDs), in particular pyrrolobenzodiazepines having a linker group connected to a cell binding agent.

BACKGROUND TO THE INVENTION

Pyrrolobenzodiazepines

Some pyrrolobenzodiazepines (PBDs) have the ability to recognise and bond to specific sequences of DNA; the preferred sequence is PuGPu. The first PBD antitumour antibiotic, anthramycin, was discovered in 1965 (Leimgruber, et al., *J. Am. Chem. Soc.*, 87, 5793-5795 (1965); Leimgruber, et al., *J. Am. Chem. Soc.*, 87, 5791-5793 (1965)). Since then, a number of naturally occurring PBDs have been reported, and over 10 synthetic routes have been developed to a variety of analogues (Thurston, et al., *Chem. Rev.* 1994, 433-465 (1994); Antonow, D. and Thurston, D. E., *Chem. Rev.* 2011 111 (4), 2815-2864). Family members include abbeymycin (Hochlowski, et al., *J. Antibiotics*, 40, 145-148 (1987)), chicamycin (Konishi, et al., *J. Antibiotics*, 37, 200-206 (1984)), DC-81 (Japanese Patent 58-180 487; Thurston, et al., *Chem. Brit.*, 26, 767-772 (1990); Bose, et al., *Tetrahedron*, 48, 751-758 (1992)), mazethramycin (Kuminoto, et al., *J. Antibiotics*, 33, 665-667 (1980)), neothramycins A and B (Takeuchi, et al., *J. Antibiotics*, 29, 93-96 (1976)), porothramycin (Tsunakawa, et al., *J. Antibiotics*, 41, 1366-1373 (1988)), prothracarcin (Shimizu, et al, *J. Antibiotics*, 29, 2492-2503 (1982); Langley and Thurston, *J. Org. Chem.*, 52, 91-97 (1987)), sibanomicin (DC-102) (Hara, et al., *J. Antibiotics*, 41, 702-704 (1988); Itoh, et al., *J. Antibiotics*, 41, 1281-1284 (1988)), sibiromycin (Leber, et al., *J. Am. Chem. Soc.*, 110, 2992-2993 (1988)) and tomamycin (Arima, et al., *J. Antibiotics*, 25, 437-444 (1972)). PBDs are of the general structure:

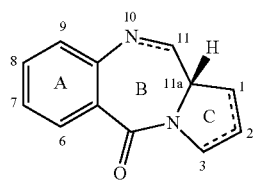

They differ in the number, type and position of substituents, in both their aromatic A rings and pyrrolo C rings, and in the degree of saturation of the C ring. In the B-ring there is either an imine (N=C), a carbinolamine(NH—CH(OH)), or a carbinolamine methyl ether (NH—CH(OMe)) at the N10-C11 position which is the electrophilic centre responsible for alkylating DNA. All of the known natural products have an (S)-configuration at the chiral C11a position which provides them with a right-handed twist when viewed from the C ring towards the A ring. This gives them the appropriate three-dimensional shape for isohelicity with the minor groove of B-form DNA, leading to a snug fit at the binding site (Kohn, In *Antibiotics III*. Springer-Verlag, New York, pp. 3-11 (1975); Hurley and Needham-VanDevanter, *Acc. Chem. Res.*, 19, 230-237 (1986)). Their ability to form an adduct in the minor groove, enables them to interfere with DNA processing, hence their use as antitumour agents.

A particularly advantageous pyrrolobenzodiazepine compound is described by Gregson et al. (*Chem. Commun.* 1999, 797-798) as compound 1, and by Gregson et al. (*J. Med. Chem.* 2001, 44, 1161-1174) as compound 4a. This compound, also known as SJG-136, is shown below:

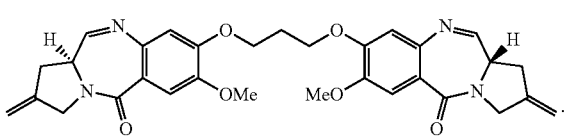

Other dimeric PBD compounds, such as those bearing C2 aryl substituents in WO 2005/085251, have been disclosed, an example being:

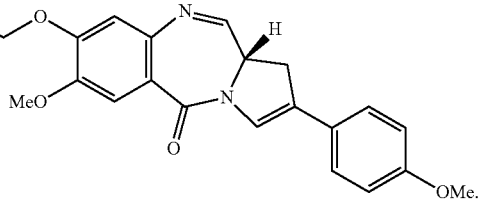

These compounds have been shown to be highly useful cytotoxic agents.

Antibody-Drug Conjugates

Antibody therapy has been established for the targeted treatment of patients with cancer, immunological and angiogenic disorders (Carter, P. (2006) Nature Reviews Immunology 6:343-357). The use of antibody-drug conjugates (ADC), i.e. immunoconjugates, for the local delivery of cytotoxic or cytostatic agents, i.e. drugs to kill or inhibit tumor cells in the treatment of cancer, targets delivery of the drug moiety to tumors, and intracellular accumulation therein, whereas systemic administration of these unconjugated drug agents may result in unacceptable levels of toxicity to normal cells as well as the tumor cells sought to be eliminated (Xie et al (2006) *Expert. Opin. Biol. Ther.* 6(3):281-291; Kovtun et al (2006) *Cancer Res.* 66(6):3214-3121; Law et al (2006) *Cancer Res.* 66(4):2328-2337; Wu et al (2005) *Nature Biotech.* 23(9):1137-1145; Lambert J. (2005) *Current Opin. in Pharmacol.* 5:543-549; Hamann P. (2005) *Expert Opin. Ther. Patents* 15(9):1087-1103; Payne, G. (2003) *Cancer Cell* 3:207-212; Trail et al (2003) *Cancer Immunol. Immunother.* 52:328-337; Syrigos and Epenetos (1999) *Anticancer Research* 19:605-614).

Maximal efficacy with minimal toxicity is sought thereby. Efforts to design and refine ADC have focused on the selectivity of monoclonal antibodies (mAbs) as well as drug mechanism of action, drug-linking, drug/antibody ratio (loading), and drug-releasing properties (Junutula, et al., 2008b Nature Biotech., 26(8):925-932; Dornan et al (2009) Blood 114(13):2721-2729; U.S. Pat. No. 7,521,541; U.S. Pat. No. 7,723,485; WO2009/052249; McDonagh (2006) Protein Eng. Design & Sel. 19(7): 299-307; Doronina et al (2006) Bioconj. Chem. 17:114-124; Erickson et al (2006) Cancer Res. 66(8):1-8; Sanderson et al (2005) Clin. Cancer Res. 11:843-852; Jeffrey et al (2005) J. Med. Chem. 48:1344-1358; Hamblett et al (2004) Clin. Cancer Res. 10:7063-7070). Drug moieties may impart their cytotoxic and cytostatic effects by mechanisms including tubulin binding, DNA binding, or topoisomerase inhibition. Some cytotoxic drugs tend to be inactive or less active when conjugated to large antibodies or protein receptor ligands.

PBDs in ADCs

Dimeric PBDs have been disclosed as the drugs in drug conjugates. For example, in WO 2011/130598, dimer PBD compounds having linker groups for connection to a cell binding agent, such as an antibody, are disclosed where the linker group is attached to one of the available N10 positions, and are generally cleaved by action of an enzyme on the linker group.

By contrast, in WO 2011/130613 and WO 2011/130616, dimer PBD compounds having linker groups for connection to a cell binding agent, such as an antibody, are disclosed where the linker group is attached via an aromatic group at one of the C2 positions, and are generally cleaved by action of an enzyme on the linker group. Such antibody drug conjugates are also described in Flyagre, J., et al, Chem. Biol. Drug Des. 81: 113-121 (2013), which also describes other types of antibody drug conjugates.

A further approach is described in WO 2007/085930, wherein tomamycin-like dimers have a linker group for connection to a cell binding agent, such as an antibody, where the linker group is attached to the tether between the tomamycin units, and are generally cleaved by action of an enzyme on the linker group.

The present inventors have developed a novel approach to forming PBD conjugates with cell binding agents, and in particular PBD antibody conjugates.

SUMMARY OF THE INVENTION

In a general aspect the present invention provides a conjugate comprising a PBD compound with a linker for connecting to a cell binding agent, wherein the linker is attached in a cleavable manner to the C7 position of the one PBD units. The cell binding agent is preferably an antibody. The invention also provides the PBD compound with the linking unit attached, and intermediates for their synthesis.

In a first aspect, the present invention provides a conjugate of formula A:

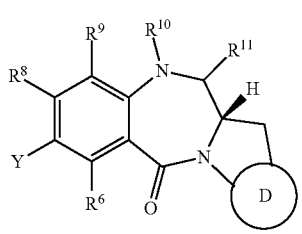

and salts and solvates thereof, wherein:
D represents either group D1 or D2:

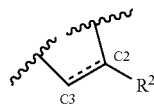

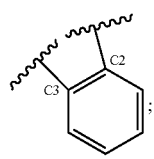

the dotted line indicates the optional presence of a double bond between C2 and C3; when there is a double bond present between C2 and C3, $R^2$ is selected from the group consisting of:

(ia) $C_{5-10}$ aryl group, optionally substituted by one or more substituents selected from the group comprising: halo, nitro, cyano, ether, carboxy, ester, $C_{1-7}$ alkyl, $C_{3-7}$ heterocyclyl and bis-oxy-$C_{1-3}$ alkylene;

(ib) $C_{1-5}$ saturated aliphatic alkyl;

(ic) $C_{3-6}$ saturated cycloalkyl;

(id)

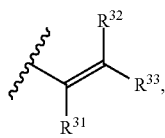

wherein each of $R^{31}$, $R^{32}$ and $R^{33}$ are independently selected from H, $C_{1-3}$ saturated alkyl, $C_{2-3}$ alkenyl, $C_{2-3}$ alkynyl and cyclopropyl, where the total number of carbon atoms in the $R^2$ group is no more than 5;

(ie)

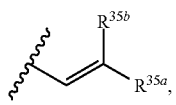

wherein one of $R^{35a}$ and $R^{35b}$ is H and the other is selected from: phenyl, which phenyl is optionally substituted by a group selected from halo, methyl, methoxy; pyridyl; and thiophenyl; and (if)

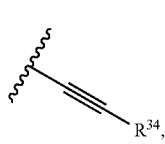

where $R^{34}$ is selected from: H; $C_{1-3}$ saturated alkyl; $C_{2-3}$ alkenyl; $C_{2-3}$ alkynyl; cyclopropyl; phenyl, which phenyl is optionally substituted by a group selected from halo, methyl, methoxy; pyridyl; and thiophenyl;

(ig) halo;
when there is a single bond present between C2 and C3, $R^2$ is

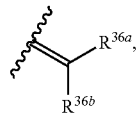

where $R^{36a}$ and $R^{36b}$ are independently selected from H, F, $C_{1-4}$ saturated alkyl, $C_{2-3}$ alkenyl, which alkyl and alkenyl groups are optionally substituted by a group selected from $C_{1-4}$ alkyl amido and $C_{1-4}$ alkyl ester; or, when one of $R^{16a}$ and $R^{16b}$ is H, the other is selected from nitrile and a $C_{1-4}$ alkyl ester;

$R^6$ and $R^9$ are independently selected from H, R, OH, OR, SH, SR, $NH_2$, NHR, NRR', $NO_2$, $SnMe_3$ and halo;

either
- (a) $R^{10}$ is H, and $R^{11}$ is OH or $OR^A$, where $R^A$ is $C_{1-4}$ alkyl; or
- (b) $R^{10}$ and $R^{11}$ form a nitrogen-carbon double bond between the nitrogen and carbon atoms to which they are bound; or
- (c) $R^{10}$ is H and $R^{11}$ is $OSO_zM$, where z is 2 or 3 and M is a monovalent pharmaceutically acceptable cation; or
- (d) $R^{11}$ is OH or $OR^A$, where $R^A$ is $C_{1-4}$ alkyl and $R^{10}$ is selected from:

(d-i)

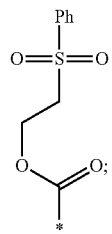

(d-ii)

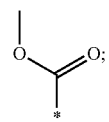

(d-iii)

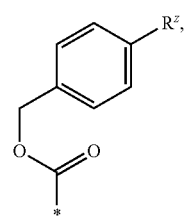

where $R^z$ is selected from:

(z-i)

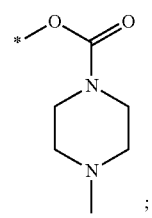 [SMILES: *OC(=O)N1CCN(C)CC1]

(z-ii) $OC(=O)CH_3$;
(z-iii) $NO_2$;
(z-iv) OMe;
(z-v) glucoronide;
(z-vi) $-C(=O)-X_1-NHC(=O)X_2-NH-R^{ZC}$, where $-C(=O)-X_1-NH-$ and $-C(=O)-X_2-NH-$ represent natural amino acid residues and $R^{ZC}$ is selected from Me, OMe, $OCH_2CH_2OMe$;

Y is selected from formulae A1 and A2:

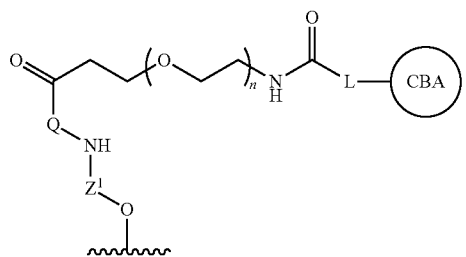

(A1)

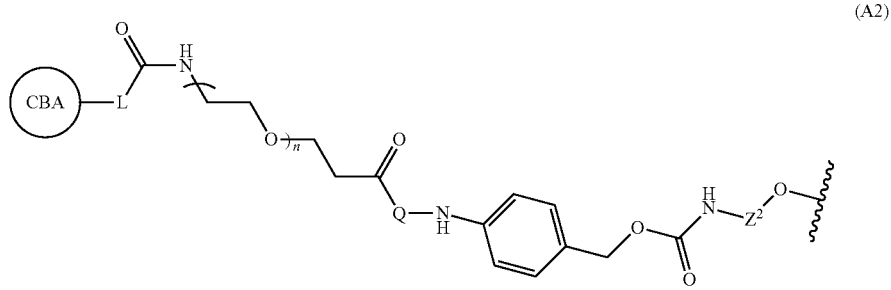

(A2)

$Z^1$ is a $C_{1-3}$ alkylene group;
$Z^2$ is a $C_{1-3}$ alkylene group;
Q is:

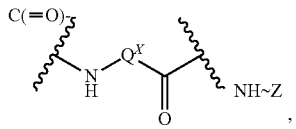

where $Q^X$ is such that Q is an amino-acid residue, a dipeptide residue or a tripeptide residue;
L is a linker connected to a cell binding agent;
CBA is the cell binding agent;
n is an integer between 0 and 48;
R and R' are each independently selected from optionally substituted $C_{1-12}$ alkyl, $C_{3-20}$ heterocyclyl and $C_{5-20}$ aryl groups, and optionally in relation to the group NRR', R and R' together with the nitrogen atom to which they are attached form an optionally substituted 4-, 5-, 6- or 7-membered heterocyclic ring;
$R^8$ is either:
(a) independently selected from H, R, OH, OR, SH, SR, $NH_2$, NHR, NRR', $NO_2$, $SnMe_3$ and halo; or
(b) of formula A*:

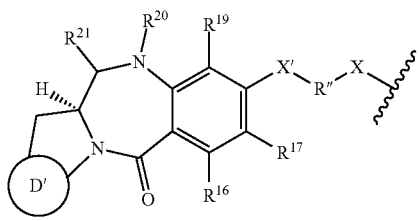

wherein:
D' represents either group D'1 or D2:

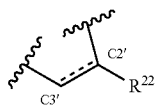

D'1

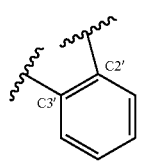

D'2 wherein the dotted line indicates the optional presence of a double bond between C2' and C3';
$R^{17}$ is independently selected from H, R, OH, OR, SH, SR, $NH_2$, NHR, NRR', $NO_2$, $SnMe_3$ and halo;
R" is a $C_{3-12}$ alkylene group, which chain may be interrupted by one or more heteroatoms, e.g. O, S, N(H), NMe and/or aromatic rings, e.g. benzene or pyridine, which rings are optionally substituted; and
X and X' are independently selected from O, S and N(H); and
$R^{22}$, $R^{16}$, $R^{19}$, $R^{20}$ and $R^{21}$ are as defined for $R^2$, $R^6$, $R^9$, $R^{10}$ and $R^{11}$ respectively.

When $R^8$ is A*, the compound is of the formula A*A:

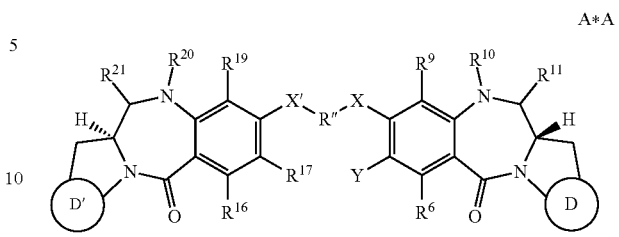

A*A

A second aspect of the present invention provides novel drug-linker compounds of formula (B):

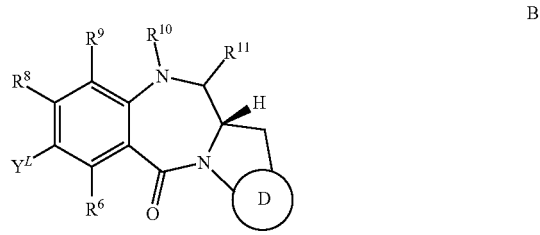

B and salts and solvates thereof, wherein:
$Y^L$ is selected from formulae B1 and B2:

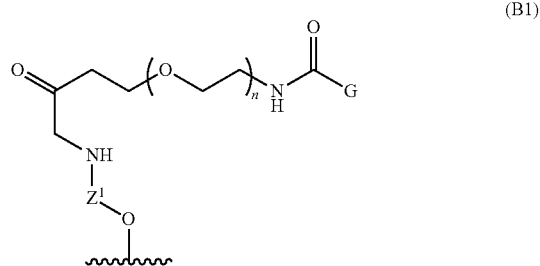

(B1)

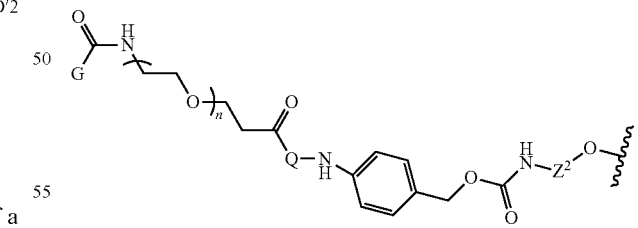

(B2)

G is a linker for connecting to a cell binding agent; and
the remaining groups are as defined in the first aspect.

A third aspect of the present invention also provides compounds of formula (C), which may be used in the preparation of the drug-linkers and conjugates of the invention:

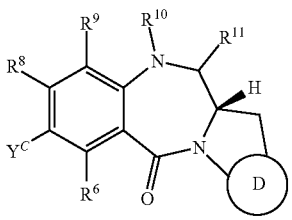

and salts and solvates thereof, $Y^C$ is selected from formulae C1 and C2:

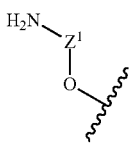
(C1)

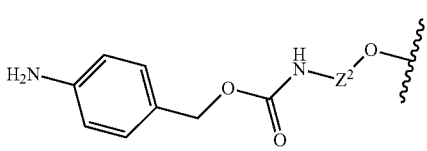
(C2)

and the remaining groups are as defined in the first aspect.

A fourth aspect of the present invention provides the use of a compound of the first aspect of the invention in a method of medical treatment. The fourth aspect also provides a pharmaceutical composition comprising a compound of the first aspect, and a pharmaceutically acceptable excipient.

A fifth aspect of the present invention provides a compound of the first aspect of the invention or a pharmaceutical composition of the fourth aspect of the invention for use in a method of treatment of a proliferative disease. The fifth aspect also provides the use of a compound of the first aspect in a method of manufacture of a medicament for the treatment of a proliferative disease, and a method of treating a mammal having a proliferative disease, comprising administering an effective amount of a compound of the first aspect or a pharmaceutical composition of the fourth aspect.

A sixth aspect of the present invention provides a method of synthesis of a compound of the first aspect of the present invention, comprising the step of conjugating a drug-linker of the second aspect with a cell-binding agent.

A seventh aspect of the present invention provides a method of synthesis of a drug-link of the second aspect, comprising the step of reacting a compound of the third aspect with one or more suitable reagents.

DETAILED DESCRIPTION OF THE INVENTION

Preferences

The following preferences may apply to all aspects of the invention as described above, or may relate to a single aspect. The preferences may be combined together in any combination.

D

In some embodiments, D is D1.
In some embodiments, D is D2.

$R^8$

In some embodiments, $R^8$ may be independently selected from H, OH, OR, SH, SR, $NH_2$, NHR, NRR', and halo.

In some embodiments, $R^8$ may be independently selected from H, OH and OR, where R may be selected from optionally substituted $C_{1-7}$ alkyl, $C_{3-10}$ heterocyclyl and $C_{5-10}$ aryl groups. R in $R^8$ may in some of these embodiments be a $C_{1-4}$ alkyl group, which may or may not be substituted. A substituent of interest is a $C_{5-6}$ aryl group (e.g. phenyl).

In some embodiments, $R^8$ is selected from OMe and $OCH_2Ph$.

In some embodiments, $R^8$ is of formula A*, such that the compound is a PBD dimer.

Dimer Link

X and X' are preferably O.

R" is a $C_{3-12}$ alkylene group, which chain may be interrupted by one or more heteroatoms, e.g. O, S, N(H), NMe and/or aromatic rings, e.g. benzene or pyridine, which rings are optionally substituted.

In some embodiments, R" may be $C_{3-12}$ alkylene group, which chain may be interrupted by one or more heteroatoms and/or aromatic rings, e.g. benzene or pyridine.

In some embodiments, R" may be $C_{3-12}$ alkylene group which is optionally interrupted by one or more heteroatoms selected from O, S, and NMe and/or aromatic rings, which rings are optionally substituted.

In some embodiments, the aromatic ring is a $C_{5-20}$ arylene group, where arylene pertains to a divalent moiety obtained by removing two hydrogen atoms from two aromatic ring atoms of an aromatic compound, which moiety has from 5 to 20 ring atoms. The ring substituents may include —$NH_2$, $CO_2H$, $SO_3H$ and N-methylpiperazine.

In some embodiments, R" may be a $C_{3-12}$ alkylene group, which chain may be interrupted by one or more heteroatoms, e.g. O, S, N(H), NMe and/or aromatic rings, e.g. benzene or pyridine, which rings are optionally substituted by $NH_2$.

In some embodiments, R" may be $C_{3-12}$ alkylene group.

In some embodiments, R" may be selected from a $C_3$, $C_5$, $C_7$, $C_9$ and a $C_{11}$ alkylene group.

In some embodiments, R" may be selected from a $C_3$, $C_5$ and a $C_7$ alkylene group.

In some embodiments, R" may be selected from a $C_3$ and a $C_5$ alkylene group.

In some embodiments, R" is a $C_3$ alkylene group.

In some embodiments, R" is a $C_5$ alkylene group.

The alkylene groups listed above may be optionally interrupted by one or more heteroatoms and/or aromatic rings, e.g. benzene or pyridine, which rings are optionally substituted.

The alkylene groups listed above may be optionally interrupted by one or more heteroatoms and/or aromatic rings, e.g. benzene or pyridine.

The alkylene groups listed above may be unsubstituted linear aliphatic alkylene groups.

R" is preferably a $C_{3-7}$ alkylene group with no substituents. More preferably R" is a $C_3$, $C_5$ or $C_7$ alkylene. Most preferably, R" is a $C_3$ or $C_5$ alkylene.

$R^6$

In some embodiments, $R^6$ may be independently selected from H, R, OH, OR, SH, SR, $NH_2$, NHR, NRR', $NO_2$, $SnMe_3$ and halo.

In some embodiments, $R^6$ may be independently selected from H, OH, OR, SH, $NH_2$, $NO_2$ and halo.

In some embodiments, $R^6$ is independently selected from H and halo.

In some embodiments, $R^6$ is independently H.

These embodiments also apply to $R^{16}$.

$R^9$

In some embodiments, $R^9$ may be independently selected from H, R, OH, OR, SH, SR, $NH_2$, NHR, NRR', $NO_2$, $SnMe_3$ and halo.

In some embodiments, $R^9$ is independently H.

These embodiments also apply to $R^{19}$.

$R^{17}$

In some embodiments, $R^{17}$ may be independently selected from H, OH, OR, SH, SR, $NH_2$, NHR, NRR', and halo.

In some embodiments, $R^{17}$ may be independently selected from H, OH and OR, where R may be selected from optionally substituted $C_{1-7}$ alkyl, $C_{3-10}$ heterocyclyl and $C_{5-10}$ aryl groups. R in $R^{17}$ may in some of these embodiments be a $C_{1-4}$ alkyl group, which may or may not be substituted. A substituent of interest is a $C_{5-6}$ aryl group (e.g. phenyl).

In some embodiments, $R^{17}$ is selected from OMe and $OCH_2Ph$.

$R^2$

When $R^2$ is a $C_{5-10}$ aryl group, in some embodiments it may be a $C_{5-7}$ aryl group. A $C_{5-7}$ aryl group may be a phenyl group or a $C_{5-7}$ heteroaryl group, for example furanyl, thiophenyl and pyridyl. In some embodiments, $R^2$ may be phenyl. In other embodiments, $R^2$ may be thiophenyl, for example, thiophen-2-yl and thiophen-3-yl.

When $R^2$ is a $C_{5-10}$ aryl group, it some embodiments it may be a $C_{8-10}$ aryl, for example a quinolinyl or isoquinolinyl group. The quinolinyl or isoquinolinyl group may be bound to the PBD core through any available ring position. For example, the quinolinyl may be quinolin-2-yl, quinolin-3-yl, quinolin-4yl, quinolin-5-yl, quinolin-6-yl, quinolin-7-yl and quinolin-8-yl. Of these quinolin-3-yl and quinolin-6-yl may be preferred. The isoquinolinyl may be isoquinolin-1-yl, isoquinolin-3-yl, isoquinolin-4yl, isoquinolin-5-yl, isoquinolin-6-yl, isoquinolin-7-yl and isoquinolin-8-yl. Of these isoquinolin-3-yl and isoquinolin-6-yl may be preferred.

When $R^2$ is a $C_{5-10}$ aryl group, it may bear any number of substituent groups. In some embodiments, it may bear from 1 to 3 substituent groups. In some embodiments, it may bear 1 or 2 substituent groups. In some embodiments, it may bear a single substituent group. The substituents may be any position.

Where $R^2$ is $C_{5-7}$ aryl group, in some embodiments a single substituent may be on a ring atom that is not adjacent the bond to the remainder of the compound, i.e. it may be β or γ to the bond to the remainder of the compound. Therefore, in embodiments where the $C_{5-7}$ aryl group is phenyl, the substituent may be in the meta- or para-positions, or may be in the para-position.

Where $R^2$ is a $C_{8-10}$ aryl group, for example quinolinyl or isoquinolinyl, in some embodiments there may be any number of substituents at any position of the quinoline or isoquinoline rings. In some embodiments, it bears one, two or three substituents, and these may be on either the proximal and distal rings or both (if more than one substituent).

$R^2$ Substituents, when $R^2$ is a $C_{5-10}$ Aryl Group

In embodiments where a substituent on $R^2$ when $R^2$ is a $C_{5-10}$ aryl group is halo, it may be F or Cl, and in some of these embodiments Cl.

In embodiments where a substituent on $R^2$ when $R^2$ is a $C_{5-10}$ aryl group is ether, it may in some embodiments be an alkoxy group, for example, a $C_{1-7}$ alkoxy group (e.g. methoxy, ethoxy) or it may in some embodiments be a $C_{5-7}$ aryloxy group (e.g phenoxy, pyridyloxy, furanyloxy). The alkoxy group may itself be further substituted, for example by an amino group (e.g. dimethylamino).

In embodiments where a substituent on $R^2$ when $R^2$ is a $C_{5-10}$ aryl group is $C_{1-7}$ alkyl, it may be a $C_{1-4}$ alkyl group (e.g. methyl, ethyl, propryl, butyl).

In embodiments where a substituent on $R^2$ when $R^2$ is a $C_{5-10}$ aryl group is $C_{3-7}$ heterocyclyl, it may be $C_6$ nitrogen containing heterocyclyl group, e.g. morpholino, thiomorpholino, piperidinyl, piperazinyl. These groups may be bound to the rest of the PBD moiety via the nitrogen atom. These groups may be further substituted, for example, by $C_{1-4}$ alkyl groups. If the $C_6$ nitrogen containing heterocyclyl group is piperazinyl, the said further substituent may be on the second nitrogen ring atom.

In embodiments where a substituent on $R^2$ when $R^2$ is a $C_{5-10}$ aryl group is bis-oxy-$C_{1-3}$ alkylene, this may be bis-oxy-methylene or bis-oxy-ethylene.

In embodiments where a substituent on $R^2$ when $R^2$ is a $C_{5-10}$ aryl group is ester, this is preferably methyl ester or ethyl ester.

In some embodiments, substituents when $R^2$ is a $C_{5-10}$ aryl group may include methoxy, ethoxy, fluoro, chloro, cyano, bis-oxy-methylene, methyl-piperazinyl, morpholino, methylthiophenyl, dimethylaminopropyloxy and carboxy.

In some embodiments, $R^2$ may be selected from 4-methoxy-phenyl, 3-methoxyphenyl, 4-ethoxy-phenyl, 3-ethoxy-phenyl, 4-fluoro-phenyl, 4-chloro-phenyl, 3,4-bisoxymethylene-phenyl, 4-methylthiophenyl, 4-cyanophenyl, 4-phenoxyphenyl, quinolin-3-yl and quinolin-6-yl, isoquinolin-3-yl and isoquinolin-6-yl, 2-thienyl, 2-furanyl, methoxynaphthyl, naphthyl, 4-nitrophenyl, 4-(4-methylpiperazin-1-yl)phenyl and 3,4-bisoxymethylene-phenyl.

When $R^2$ is $C_{1-5}$ saturated aliphatic alkyl, it may be methyl, ethyl, propyl, butyl or pentyl. In some embodiments, it may be methyl, ethyl or propyl (n-pentyl or isopropyl). In some of these embodiments, it may be methyl. In other embodiments, it may be butyl or pentyl, which may be linear or branched.

When $R^2$ is $C_{3-6}$ saturated cycloalkyl, it may be cyclopropyl, cyclobutyl, cyclopentyl or cyclohexyl. In some embodiments, it may be cyclopropyl.

When $R^2$ is

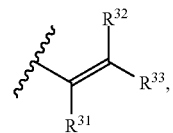

in some embodiments, the total number of carbon atoms in the $R^2$ group is no more than 4 or no more than 3.

In some embodiments, one of $R^{31}$, $R^{32}$ and $R^{33}$ is H, with the other two groups being selected from H, $C_{1-3}$ saturated alkyl, $C_{2-3}$ alkenyl, $C_{2-3}$ alkynyl and cyclopropyl.

In other embodiments, two of $R^{31}$, $R^{32}$ and $R^{33}$ are H, with the other group being selected from H, $C_{1-3}$ saturated alkyl, $C_{2-3}$ alkenyl, $C_{2-3}$ alkynyl and cyclopropyl.

In some embodiments, the groups that are not H are selected from methyl and ethyl. In some of these embodiments, the groups that are not H are methyl.

In some embodiments, $R^{31}$ is H.

In some embodiments, $R^{32}$ is H.

In some embodiments, $R^{33}$ is H.
In some embodiments, $R^{31}$ and $R^{32}$ are H.
In some embodiments, $R^{31}$ and $R^{33}$ are H.
In some embodiments, $R^{32}$ and $R^{33}$ are H.
A $R^2$ group of particular interest is:

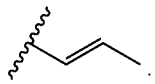 [SMILES: */C=C/C]

When $R^2$ is

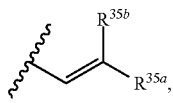

in some embodiments, the group ($R^{35a}$ or $R^{35b}$) which is not H is optionally substituted phenyl. If the phenyl optional substituent is halo, it may be fluoro. In some embodiment, the phenyl group is unsubstituted.
When $R^2$ is

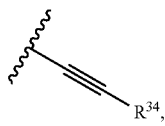

in some embodiments where $R^{34}$ is phenyl, it is unsubstituted. In other embodiments, the phenyl group bears a single fluoro substituent. In other embodiments, $R^{14}$ is selected from H, methyl, ethyl, ethenyl and ethynyl. In some of these embodiments, $R^{14}$ is selected from H and methyl.
When $R^2$ is halo, in some embodiments, it is fluoro.
When there is a single bond present between C2 and C3, $R^2$ is

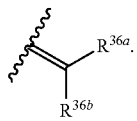

In some embodiments, $R^{36a}$ and $R^{36b}$ are both H.
In other embodiments, $R^{36a}$ and $R^{36b}$ are both methyl.
In further embodiments, one of $R^{36a}$ and $R^{36b}$ is H, and the other is selected from $C_{1-4}$ saturated alkyl, $C_{2-3}$ alkenyl, which alkyl and alkenyl groups are optionally substituted. In some of these further embodiment, the group which is not H may be selected from methyl and ethyl.
$R^{22}$
The above preferences for $R^2$ when there is a double bond present between C2 and C3 apply equally to $R^{22}$, when there is a double bond present between C2' and C3'.
The above preferences for $R^2$ when there is a single bond present between C2 and C3 apply equally to $R^{22}$, when there is a single bond present between C2' and C3'.
N10-C11
In some embodiment, $R^{10}$ is H, and $R^{11}$ is OH, $OR^A$, where $R^A$ is $C_{1-4}$ alkyl. In some of these embodiments, $R^{11}$ is OH. In others of these embodiments, $R^{11}$ is $OR^A$, where $R^A$ is $C_{1-4}$ alkyl. In some of these embodiments, $R^A$ is methyl.

In some embodiments, $R^{10}$ and $R^{11}$ form a nitrogen-carbon double bond between the nitrogen and carbon atoms to which they are bound.

In some embodiments, $R^{10}$ is H and $R^{11}$ is $OSO_zM$, where z is 2 or 3 and M is a monovalent pharmaceutically acceptable cation. In some of these embodiments, M is a monovalent pharmaceutically acceptable cation, and may be $Na^+$. Furthermore, in some embodiments z is 3.

In some embodiments where $R^{10}$ is (d-iii), there may be an additional nitro group on the benzene ring, e.g. ortho to $R^Z$.

In some embodiments, $R^{11}$ is OH or $OR^A$, where $R^A$ is $C_{1-4}$ alkyl and $R^{10}$ is selected from:

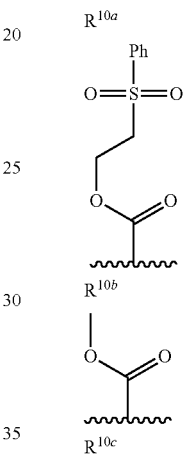

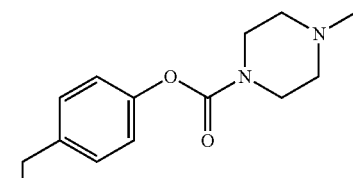

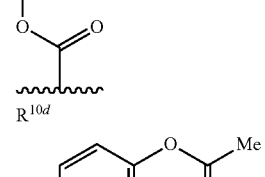

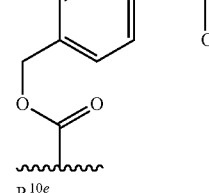

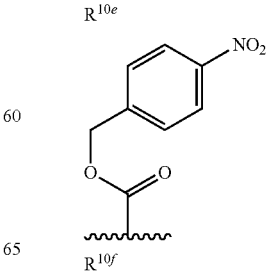

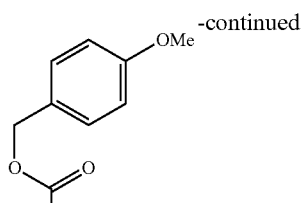

R[10g]

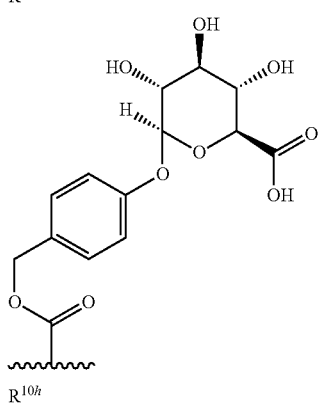

R[10h]

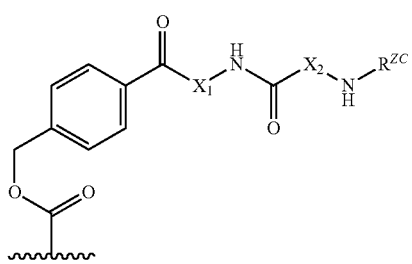

—C(=O)—X$_1$—NHC(=O)X$_2$—NH— represent a dipeptide. The amino acids in the dipeptide may be any combination of natural amino acids. The dipeptide may be the site of action for cathepsin-mediated cleavage.

In one embodiment, the dipeptide, —C(=O)—X$_1$—NHC(=O)X$_2$—NH—, is selected from:
-Phe-Lys-,
-Val-Ala-,
-Val-Lys-,
-Ala-Lys-,
-Val-Cit-,
-Phe-Cit-,
-Leu-Cit-,
-Ile-Cit-,
-Phe-Arg-,
-Trp-Cit-,
where Cit is citrulline.

Preferably, the dipeptide, —C(=O)—X$_1$—NHC(=O) X$_2$—NH—, is selected from:
-Phe-Lys-,
-Val-Ala-,
-Val-Lys-,
-Ala-Lys-,
-Val-Cit-.

Most preferably, the dipeptide, —C(=O)—X$_1$—NHC(=O)X$_2$—NH—, is -Phe-Lys- or -Val-Ala-.

Other dipeptide combinations may be used, including those described by Dubowchik et al., *Bioconjugate Chemistry*, 2002, 13, 855-869, which is incorporated herein by reference.

In one embodiment, the amino acid side chain is derivatised, where appropriate. For example, an amino group or carboxy group of an amino acid side chain may be derivatised.

In one embodiment, an amino group NH$_2$ of a side chain amino acid, such as lysine, is a derivatised form selected from the group consisting of NHR and NRR'.

In one embodiment, a carboxy group COOH of a side chain amino acid, such as aspartic acid, is a derivatised form selected from the group consisting of COOR, CONH$_2$, CONHR and CONRR'.

In one embodiment, the amino acid side chain is chemically protected, where appropriate.

The side chain protecting group may be a group as discussed above. The present inventors have established that protected amino acid sequences are cleavable by enzymes. For example, it has been established that a dipeptide sequence comprising a Boc side chain-protected Lys residue is cleavable by cathepsin.

Protecting groups for the side chains of amino acids are well known in the art and are described in the Novabiochem Catalog. Additional protecting group strategies are set out in Protective Groups in Organic Synthesis, Greene and Wuts.

Possible side chain protecting groups are shown below for those amino acids having reactive side chain functionality:
Arg: Z, Mtr, Tos;
Asn: Trt, Xan;
Asp: Bzl, t-Bu;
Cys: Acm, Bzl, Bzl-OMe, Bzl-Me, Trt;
Glu: Bzl, t-Bu;
Gln: Trt, Xan;
His: Boc, Dnp, Tos, Trt;
Lys: Boc, Z—Cl, Fmoc, Z, Alloc;
Ser: Bzl, TBDMS, TBDPS;
Thr: Bz;
Trp: Boc;
Tyr: Bzl, Z, Z—Br.

In one embodiment, the side chain protection is selected to be orthogonal to a group provided as, or as part of, a capping group, where present. Thus, the removal of the side chain protecting group does not remove the capping group, or any protecting group functionality that is part of the capping group.

In other embodiments of the invention, the amino acids selected are those having no reactive side chain functionality. For example, the amino acids may be selected from: Ala, Gly, Ile, Leu, Met, Phe, Pro, and Val.

It is particularly preferred in the present invention, that if L$^1$ comprises a dipeptide, then —C(=O)—X$_1$—NHC(=O) X$_2$—NH— is the same dipeptide.

Other preferred R$^{10}$ groups include:

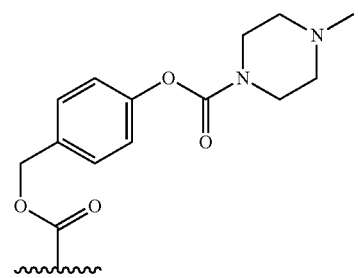

and

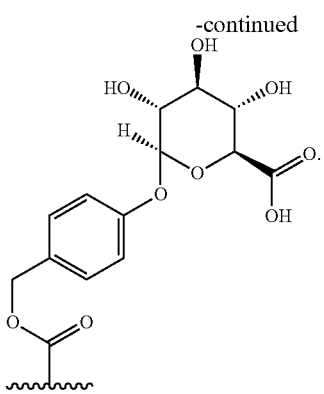

The above preferences apply equally to $R^{20}$ and $R^{21}$.

R and R'

In some embodiments, R is independently selected from optionally substituted $C_{1-12}$ alkyl, $C_{3-20}$ heterocyclyl and $C_{5-20}$ aryl groups. These groups are each defined in the substituents section below.

In some embodiments, R is independently optionally substituted $C_{1-12}$ alkyl. In other embodiments, R is independently optionally substituted $C_{3-20}$ heterocyclyl. In further embodiments, R is independently optionally substituted $C_{5-20}$ aryl. In further embodiments, R is independently optionally substituted $C_{1-12}$ alkyl.

Described above in relation to $R^2$ are various embodiments relating to preferred alkyl and aryl groups and the identity and number of optional substituents. The preferences set out for $R^2$ as it applies to R are applicable, where appropriate, to all other groups R.

The preferences for R apply also to R'.

In some embodiments of the invention there is provided a compound having a substituent group —NRR'. In one embodiment, R and R' together with the nitrogen atom to which they are attached form an optionally substituted 4-, 5-, 6- or 7-membered heterocyclic ring. The ring may contain a further heteroatom, for example N, O or S. In some of these embodiments, the heterocyclic ring is itself substituted with a group R. Where a further N heteroatom is present, the substituent may be on the N heteroatom.

Dimers

In some embodiments, the groups X', D, $R^{16}$, $R^{19}$, $R^{20}$ and $R^{21}$ are the same as the groups X, D', $R^6$, $R^9$, $R^{10}$ and $R^{11}$ respectively. In these embodiments, the PBD monomer units have the same substituents except for at the 7 position.

Particularly preferred compounds of the first aspect of the present invention may be of formula Ia:

where $R^{10}$, $R^{11}$, $R^{20}$, $R^{21}$ and Y are as defined above;

m is 1 or 3;

$R^{1a}$ is methyl or phenyl; and $R^{2a}$ is selected from:

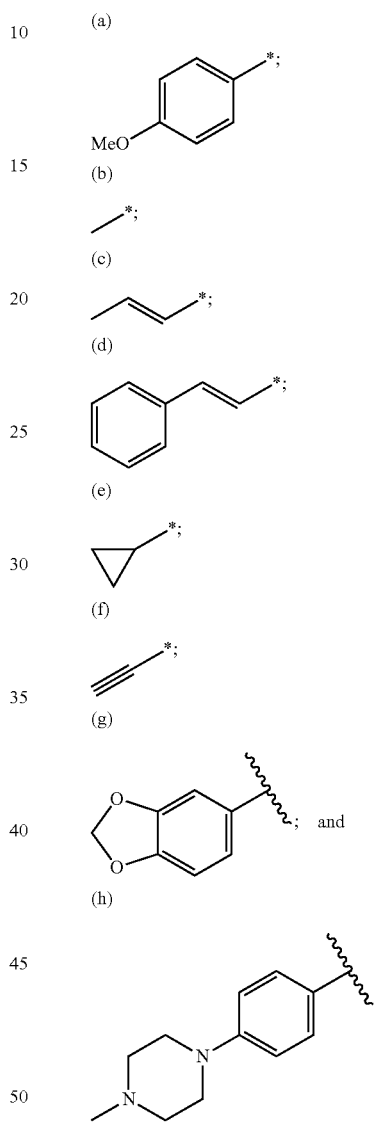

Particularly preferred compounds of the first aspect of the present invention may be of formula Ib:

Ia

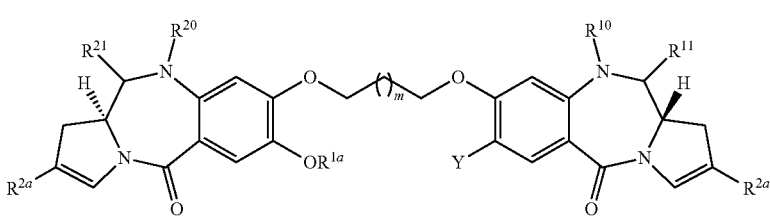

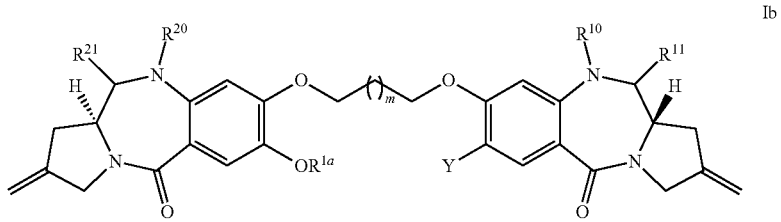

Ib where
$R^{10}$, $R^{11}$, $R^{20}$, $R^{21}$ and Y are as defined above;
m is 1 or 3; and
$R^{1a}$ is methyl or phenyl.

Particularly preferred compounds of the second aspect of the present invention may be of formula IIa:

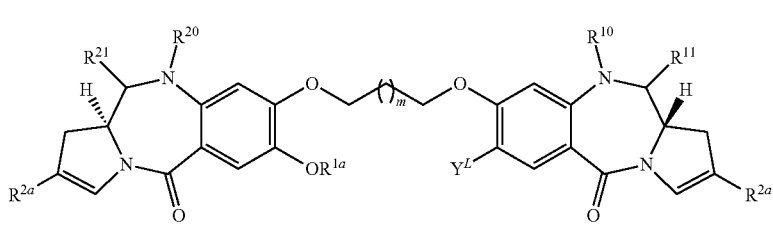

IIa where
$R^{10}$, $R^{11}$, $R^{20}$, $R^{21}$ and $Y^L$ are as defined above;
m is 1 or 3;
$R^{1a}$ is methyl or phenyl; and
$R^{2a}$ is selected from:

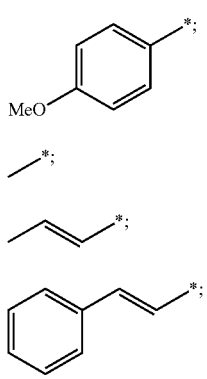

(a)

(b)

(c)

(d)

-continued

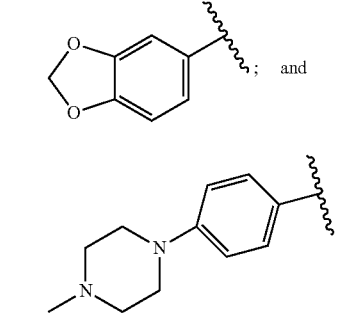

(e)

(f)

(g)

(h)

Particularly preferred compounds of the second aspect of the present invention may be of formula IIb:

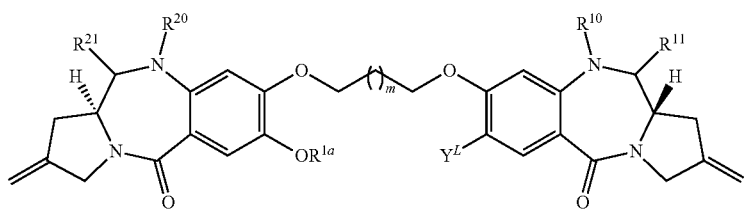

IIb where
$R^{10}$, $R^{11}$, $R^{20}$, $R^{21}$ and $Y^L$ are as defined above;
m is 1 or 3; and
$R^{1a}$ is methyl or phenyl.

Particularly preferred compounds of the third aspect of the present invention may be of formula IIIa:

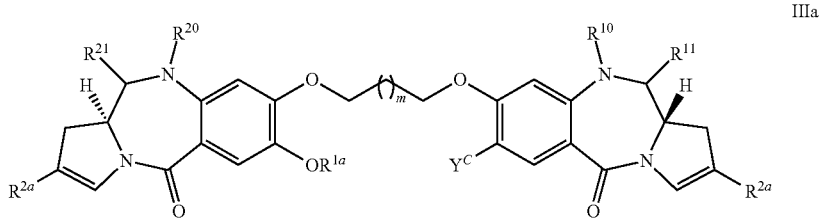

where
$R^{10}$, $R^{11}$, $R^{20}$, $R^{21}$ and $Y^C$ are as defined above;
m is 1 or 3;
$R^{1a}$ is methyl or phenyl; and
$R^{2a}$ is selected from:

(a)
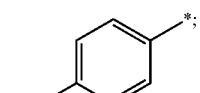

(b)

(c)
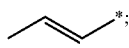

(d)
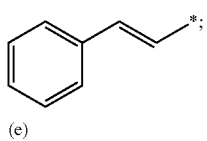

(e)

(f)

(g)
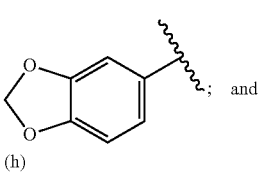; and (h)
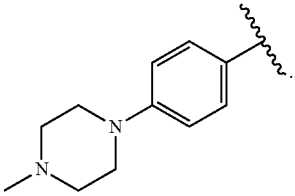

Particularly preferred compounds of the third aspect of the present invention may be of formula IIIb:

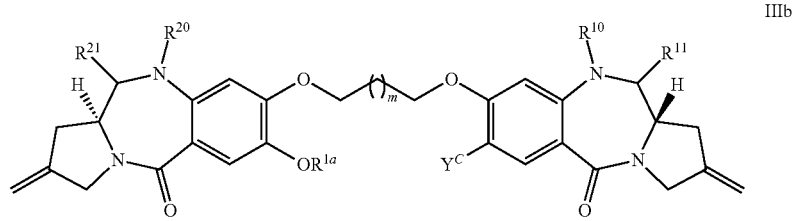

where
$R^{10}$, $R^{11}$, $R^{20}$, $R^{21}$ and $Y^C$ are as defined above;
m is 1 or 3; and
$R^{1a}$ is methyl or phenyl.

$Z^1$, $Z^2$, $Z^3$

In some embodiments, $Z^1$ is methylene. In some embodiments, $Z^1$ is ethylene. In some embodiments, $Z^1$ is propylene.

In some embodiments, $Z^2$ is methylene. In some embodiments, $Z^2$ is ethylene. In some embodiments, $Z^2$ is propylene.

In some embodiments, $Z^3$ is methylene. In some embodiments, $Z^3$ is ethylene. In some embodiments, $Z^3$ is propylene.

n (Y, $Y^L$)

In some embodiments, n (in Y or $Y^L$) is an integer between 0 and 24.

In some embodiments, n (in Y or $Y^L$) is an integer between 0 and 12.

In some embodiments, n (in Y or $Y^L$) is an integer between 0 and 8.

In some embodiments, n (in Y or $Y^L$) is an integer between 0 and 6.

In some embodiments, n (in Y or $Y^L$) is 0.
In some embodiments, n (in Y or $Y^L$) is 1.
In some embodiments, n (in Y or $Y^L$) is 2.
In some embodiments, n (in Y or $Y^L$) is 3.
In some embodiments, n (in Y or $Y^L$) is 4.
In some embodiments, n (in Y or $Y^L$) is 5.
In some embodiments, n (in Y or $Y^L$) is 6.
In some embodiments, n (in Y or $Y^L$) is 7.
In some embodiments, n (in Y or $Y^L$) is 8.
In some embodiments, $Z^1$ is methylene and n is 3.
In some embodiments, $Z^2$ is propylene and n is 8.

$Q^X$

In one embodiment, Q is an amino acid residue. The amino acid may a natural amino acids or a non-natural amino acid.

In one embodiment, Q is selected from: Phe, Lys, Val, Ala, Cit, Leu, Ile, Arg, and Trp, where Cit is citrulline.

In one embodiment, Q comprises a dipeptide residue. The amino acids in the dipeptide may be any combination of natural amino acids and non-natural amino acids. In some embodiments, the dipeptide comprises natural amino acids. Where the linker is a cathepsin labile linker, the dipeptide is the site of action for cathepsin-mediated cleavage. The dipeptide then is a recognition site for cathepsin.

In one embodiment, Q is selected from:
$^{NH}$-Phe-Lys-$^{C=O}$,
$^{NH}$Val-Ala-$^{C=O}$,
$^{NH}$Val-Lys-$^{C=O}$,
$^{NH}$Ala-Lys-$^{C=O}$,
$^{NH}$-Val-Cit-$^{C=O}$,
$^{NH}$-Phe-Cit-$^{C=O}$,
$^{NH}$-Leu-Cit-$^{C=O}$,
$^{NH}$-Ile-Cit-$^{C=O}$,
$^{NH}$-Phe-Arg-$^{C=O}$, and
$^{NH}$-Trp-Cit-$^{C=O}$;
where Cit is citrulline.

Preferably, Q is selected from:
$^{NH}$-Phe-Lys-$^{C=O}$,
$^{NH}$-Val-Ala-$^{C=O}$,
$^{NH}$-Val-Lys-$^{C=O}$,
$^{NH}$-Ala-Lys-$^{C=O}$, and
$^{NH}$-Val-Cit-$^{C=O}$.

Most preferably, Q is selected from $^{NH}$-Phe-Lys-$^{C=O}$, $^{NH}$-Val-Cit-$^{C=O}$ or $^{NH}$-Val-Ala-$^{C=O}$.

Other dipeptide combinations of interest include:
$^{NH}$-Gly-Gly-$^{C=O}$,
$^{NH}$-Pro-Pro-$^{C=O}$, and
$^{NH}$-Val-Glu-$^{C=O}$.

Other dipeptide combinations may be used, including those described by Dubowchik et al., *Bioconjugate Chemistry*, 2002, 13, 855-869, which is incorporated herein by reference.

In some embodiments, Q is a tripeptide residue. The amino acids in the tripeptide may be any combination of natural amino acids and non-natural amino acids. In some embodiments, the tripeptide comprises natural amino acids. Where the linker is a cathepsin labile linker, the tripeptide is the site of action for cathepsin-mediated cleavage. The tripeptide then is a recognition site for cathepsin.

In one embodiment, the amino acid side chain is chemically protected, where appropriate. The side chain protecting group may be a group as discussed above. Protected amino acid sequences are cleavable by enzymes. For example, a dipeptide sequence comprising a Boc side chain-protected Lys residue is cleavable by cathepsin.

Protecting groups for the side chains of amino acids are well known in the art and are described in the Novabiochem Catalog, and as described above.

In some embodiments, the groups Q and —C(=O)—$X_1$—NHC(=O)$X_2$—NH— may be the same.

In some embodiments, the groups Q and —C(=O)—$X_1$—NHC(=O)$X_2$—NH— may be different.

L and G

L is a linker connected to the cell binding agent in the conjugate compound. G is a linker for connecting the PBD dimer to the cell binding agent to form the conjugate compound.

Preferably, the linker contains an electrophilic functional group for reaction with a nucleophilic functional group on the cell binding agent. Nucleophilic groups on antibodies include, but are not limited to: (i) N-terminal amine groups, (ii) side chain amine groups, e.g. lysine, (iii) side chain thiol groups, e.g. cysteine, and (iv) sugar hydroxyl or amino groups where the antibody is glycosylated. Amine, thiol, and hydroxyl groups are nucleophilic and capable of reacting to form covalent bonds with electrophilic groups on linker moieties and linker reagents including: (i) maleimide groups (ii) activated disulfides, (iii) active esters such as NHS (N-hydroxysuccinimide) esters, HOBt (N-hydroxybenzotriazole) esters, haloformates, and acid halides; (iv) alkyl and benzyl halides such as haloacetamides; and (v) aldehydes, ketones, carboxyl, and, some of which are exemplified as follows:

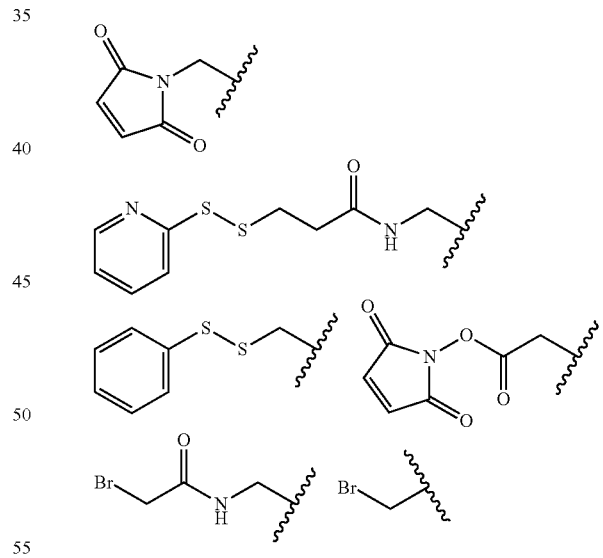

Certain antibodies have reducible interchain disulfides, i.e. cysteine bridges. Antibodies may be made reactive for conjugation with linker reagents by treatment with a reducing agent such as DTT (dithiothreitol). Each cysteine bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol. Reactive thiol groups may be introduced into the antibody (or fragment thereof) by introducing one, two, three, four, or more cysteine residues (e.g., preparing mutant antibodies comprising one or more non-native cysteine amino acid residues). U.S. Pat. No. 7,521,541 teaches engineering antibodies by introduction of reactive cysteine amino acids. In some embodiments, a Linker has a reactive nucleophilic group which is reactive with an electrophilic group present on an antibody. Useful electrophilic groups on an antibody include, but are not limited to, aldehyde and ketone carbonyl groups. The heteroatom of a nucleophilic group of a Linker can react with an electrophilic group on an antibody and form a covalent bond to an antibody unit. Useful nucleophilic groups on a Linker include, but are not limited to, hydrazide, oxime, amino, hydroxyl, hydrazine, thiosemicarbazone, hydrazine carboxylate, and arylhydrazide. The electrophilic group on an antibody provides a convenient site for attachment to a Linker.

In one embodiment, the group L is:

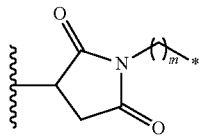

where the asterisk indicates the point of attachment to the rest of group Y, the wavy line indicates the point of attachment to the cell binding agent, and m is 0 to 6. In one embodiment, m is 5.

In one embodiment, the connection between the cell binding agent and L is through a thiol residue of the cell binding agent and a maleimide group of L.

In one embodiment, the connection between the cell binding agent and L is:

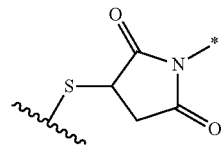 [SMILES: *SC1CC(=O)N(*)C1=O]

where the asterisk indicates the point of attachment to the remaining portion of the L group or the remaining portion of the Y group and the wavy line indicates the point of attachment to the remaining portion of the cell binding agent. In this embodiment, the S atom is typically derived from the cell binding agent.

In each of the embodiments above, an alternative functionality may be used in place of the maleimide-derived group shown below:

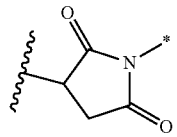

where the wavy line indicates the point of attachment to the cell binding agent as before, and the asterisk indicates the bond to the remaining portion of the L group or the remaining portion of the Y group.

In one embodiment, the maleimide-derived group is replaced with the group:

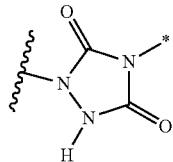 [SMILES: *n1[nH]c(=O)n(*)c1=O]

where the wavy line indicates point of attachment to the cell binding agent, and the asterisk indicates the bond to the remaining portion of the L group or the remaining portion of the Y group.

In one embodiment, the maleimide-derived group is replaced with a group, which optionally together with the cell binding agent, is selected from:
—C(═O)NH—,
—C(═O)O—,
—NHC(═O)—,
—OC(═O)—,
—OC(═O)O—,
—NHC(═O)O—,
—OC(═O)NH—,
—NHC(═O)NH—,
—NHC(═O)NH,
—C(═O)NHC(═O)—,
—S—,
—S—S—,
—CH$_2$C(═O)—
—C(═O)CH$_2$—,
═N—NH—, and
—NH—N═.

In one embodiment, the maleimide-derived group is replaced with a group, which optionally together with the cell binding agent, is selected from:

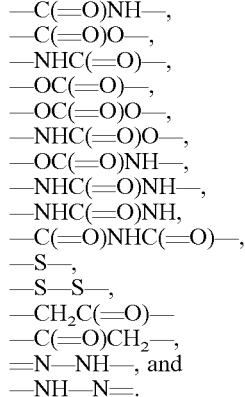

where the wavy line indicates either the point of attachment to the cell binding agent or the bond to the remaining portion of the L group or the remaining portion of the Y group, and the asterisk indicates the other of the point of attachment to the cell binding agent or the bond to the remaining portion of the L group or the remaining portion of the Y group.

Other groups that can be used as L for connecting the remaining portion of the Y group to the cell binding agent are described in WO 2005/082023.

Thus, in embodiments of the present invention, L is of formula:

-L$^A$-(CH$_2$)$_m$—

Where m is from 0 to 6; and
L$^A$ is selected from:

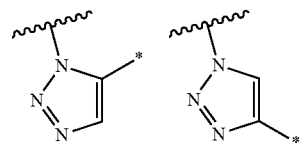 [SMILES: *c1cnnn1* ; *c1cn(*)nn1]

(L$^{A1-1}$)

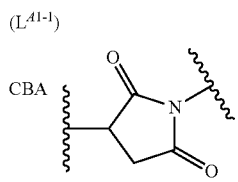

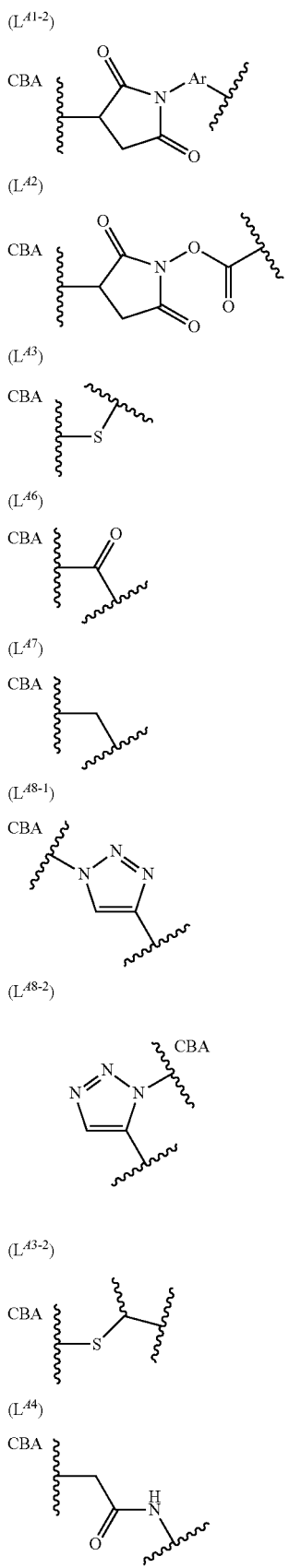
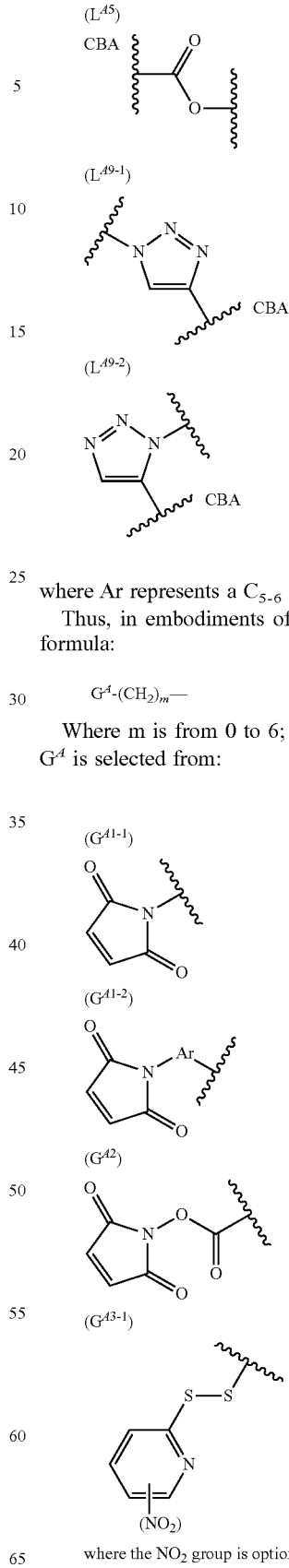
where Ar represents a $C_{5-6}$ arylene group, e.g. phenylene.
Thus, in embodiments of the present invention, G is of formula:
$$G^A\text{-}(CH_2)_m\text{---}$$
Where m is from 0 to 6; and
$G^A$ is selected from:
where the $NO_2$ group is optional (G^{A4})

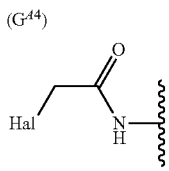

Where Hal = I, Br, Cl (G^{A5})

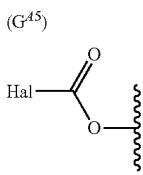

(G^{A6})

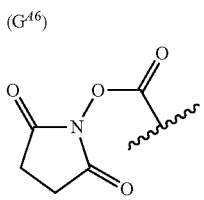

(G^{A7})

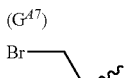

(G^{A3-2})

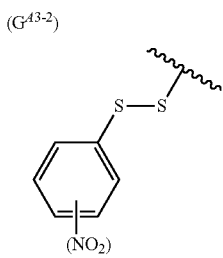

where the NO₂ group is optional (G^{A3-3})

where the NO₂ group is optional (G^{A3-4})

where the NO₂ group is optional (G^{A8})

(G^{A9})

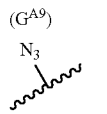

where Ar represents a $C_{5-6}$ arylene group, e.g. phenylene.

In some embodiments, m may be 2 or 5.

Cell Binding Agent

A cell binding agent may be of any kind, and include peptides and non-peptides. These can include antibodies or a fragment of an antibody that contains at least one binding site, lymphokines, hormones, hormone mimetics, vitamins, growth factors, nutrient-transport molecules, or any other cell binding molecule or substance.

Peptides

In one embodiment, the cell binding agent is a linear or cyclic peptide comprising 4-30, preferably 6-20, contiguous amino acid residues. In this embodiment, it is preferred that one cell binding agent is linked to one monomer or dimer pyrrolobenzodiazepine compound.

In one embodiment the cell binding agent comprises a peptide that binds integrin $\alpha_v\beta_6$. The peptide may be selective for $\alpha_v\beta_6$ over XYS.

In one embodiment the cell binding agent comprises the A20FMDV-Cys polypeptide. The A20FMDV-Cys has the sequence: NAVPNLRGDLQVLAQKVARTC. Alternatively, a variant of the A20FMDV-Cys sequence may be used wherein one, two, three, four, five, six, seven, eight, nine or ten amino acid residues are substituted with another amino acid residue. Furthermore, the polypeptide may have the sequence NAVXXXXXXXXXXXXXXXXRTC.

Antibodies

The term "antibody" herein is used in the broadest sense and specifically covers monoclonal antibodies, polyclonal antibodies, dimers, multimers, multispecific antibodies (e.g., bispecific antibodies), and antibody fragments, so long as they exhibit the desired biological activity (Miller et al (2003) Jour. of Immunology 170:4854-4861). Antibodies may be murine, human, humanized, chimeric, or derived from other species. An antibody is a protein generated by the immune system that is capable of recognizing and binding to a specific antigen. (Janeway, C., Travers, P., Walport, M., Shlomchik (2001) Immuno Biology, 5th Ed., Garland Publishing, New York). A target antigen generally has numerous binding sites, also called epitopes, recognized by CDRs on multiple antibodies. Each antibody that specifically binds to a different epitope has a different structure. Thus, one antigen may have more than one corresponding antibody. An antibody includes a full-length immunoglobulin molecule or an immunologically active portion of a full-length immunoglobulin molecule, i.e., a molecule that contains an antigen binding site that immunospecifically binds an antigen of a target of interest or part thereof, such targets including but not limited to, cancer cell or cells that produce autoimmune antibodies associated with an autoimmune disease. The immunoglobulin can be of any type (e.g. IgG, IgE, IgM, IgD, and IgA), class (e.g. IgG1, IgG2, IgG3, IgG4, IgA1 and IgA2) or subclass of immunoglobulin molecule. The immunoglobulins can be derived from any species, including human, murine, or rabbit origin.

"Antibody fragments" comprise a portion of a full length antibody, generally the antigen binding or variable region thereof. Examples of antibody fragments include Fab, Fab', F(ab')₂, and scFv fragments; diabodies; linear antibodies; fragments produced by a Fab expression library, anti-idiotypic (anti-Id) antibodies, CDR (complementary determining region), and epitope-binding fragments of any of the above which immunospecifically bind to cancer cell antigens, viral antigens or microbial antigens, single-chain antibody molecules; and multispecific antibodies formed from antibody fragments.

The term "monoclonal antibody" as used herein refers to an antibody obtained from a population of substantially homogeneous antibodies, i.e. the individual antibodies comprising the population are identical except for possible naturally occurring mutations that may be present in minor amounts. Monoclonal antibodies are highly specific, being directed against a single antigenic site. Furthermore, in contrast to polyclonal antibody preparations which include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al (1975) Nature 256:495, or may be made by recombinant DNA methods (see, U.S. Pat. No. 4,816,567). The monoclonal antibodies may also be isolated from phage antibody libraries using the techniques described in Clackson et al (1991) Nature, 352:624-628; Marks et al (1991) J. Mol. Biol., 222:581-597 or from transgenic mice carrying a fully human immunoglobulin system (Lonberg (2008) Curr. Opinion 20(4):450-459).

The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al (1984) Proc. Natl. Acad. Sci. USA, 81:6851-6855). Chimeric antibodies include "primatized" antibodies comprising variable domain antigen-binding sequences derived from a non-human primate (e.g. Old World Monkey or Ape) and human constant region sequences.

An "intact antibody" herein is one comprising a VL and VH domains, as well as a light chain constant domain (CL) and heavy chain constant domains, CH1, CH2 and CH3. The constant domains may be native sequence constant domains (e.g. human native sequence constant domains) or amino acid sequence variant thereof. The intact antibody may have one or more "effector functions" which refer to those biological activities attributable to the Fc region (a native sequence Fc region or amino acid sequence variant Fc region) of an antibody. Examples of antibody effector functions include C1q binding; complement dependent cytotoxicity; Fc receptor binding; antibody-dependent cell-mediated cytotoxicity (ADCC); phagocytosis; and down regulation of cell surface receptors such as B cell receptor and BCR.

Depending on the amino acid sequence of the constant domain of their heavy chains, intact antibodies can be assigned to different "classes." There are five major classes of intact antibodies: IgA, IgD, IgE, IgG, and IgM, and several of these may be further divided into "subclasses" (isotypes), e.g., IgG1, IgG2, IgG3, IgG4, IgA, and IgA2. The heavy-chain constant domains that correspond to the different classes of antibodies are called $\alpha$, $\delta$, $\epsilon$, $\gamma$, and $\mu$, respectively. The subunit structures and three-dimensional configurations of different classes of immunoglobulins are well known.

Humanisation

Techniques to reduce the in vivo immunogenicity of a non-human antibody or antibody fragment include those termed "humanisation".

A "humanized antibody" refers to a polypeptide comprising at least a portion of a modified variable region of a human antibody wherein a portion of the variable region, preferably a portion substantially less than the intact human variable domain, has been substituted by the corresponding sequence from a non-human species and wherein the modified variable region is linked to at least another part of another protein, preferably the constant region of a human antibody. The expression "humanized antibodies" includes human antibodies in which one or more complementarity determining region ("CDR") amino acid residues and/or one or more framework region ("FW" or "FR") amino acid residues are substituted by amino acid residues from analogous sites in rodent or other non-human antibodies. The expression "humanized antibody" also includes an immunoglobulin amino acid sequence variant or fragment thereof that comprises an FR having substantially the amino acid sequence of a human immunoglobulin and a CDR having substantially the amino acid sequence of a non-human immunoglobulin.

"Humanized" forms of non-human (e.g., murine) antibodies are chimeric antibodies that contain minimal sequence derived from non-human immunoglobulin. Or, looked at another way, a humanized antibody is a human antibody that also contains selected sequences from non-human (e.g. murine) antibodies in place of the human sequences. A humanized antibody can include conservative amino acid substitutions or non-natural residues from the same or different species that do not significantly alter its binding and/or biologic activity.

Such antibodies are chimeric antibodies that contain minimal sequence derived from non-human immunoglobulins.

There are a range of humanisation techniques, including 'CDR grafting', 'guided selection', 'deimmunization', 'resurfacing' (also known as 'veneering'), 'composite antibodies', 'Human String Content Optimisation' and framework shuffling.

CDR Grafting

In this technique, the humanized antibodies are human immunoglobulins (recipient antibody) in which residues from a complementary-determining region (CDR) of the recipient antibody are replaced by residues from a CDR of a non-human species (donor antibody) such as mouse, rat, camel, bovine, goat, or rabbit having the desired properties (in effect, the non-human CDRs are 'grafted' onto the human framework). In some instances, framework region (FR) residues of the human immunoglobulin are replaced by corresponding non-human residues (this may happen when, for example, a particular FR residue has significant effect on antigen binding).

Furthermore, humanized antibodies can comprise residues that are found neither in the recipient antibody nor in the imported CDR or framework sequences. These modifications are made to further refine and maximize antibody performance. Thus, in general, a humanized antibody will comprise all of at least one, and in one aspect two, variable domains, in which all or all of the hypervariable loops correspond to those of a non-human immunoglobulin and all or substantially all of the FR regions are those of a human immunoglobulin sequence. The humanized antibody optionally also will comprise at least a portion of an immunoglobulin constant region (Fc), or that of a human immunoglobulin.

Guided Selection

The method consists of combining the $V_H$ or $V_L$ domain of a given non-human antibody specific for a particular epitope with a human $V_H$ or $V_L$ library and specific human V domains are selected against the antigen of interest. This selected human VH is then combined with a VL library to generate a completely human VH×VL combination. The method is described in Nature Biotechnology (N.Y.) 12, (1994) 899-903.

Composite Antibodies

In this method, two or more segments of amino acid sequence from a human antibody are combined within the final antibody molecule. They are constructed by combining multiple human VH and VL sequence segments in combinations which limit or avoid human T cell epitopes in the final composite antibody V regions. Where required, T cell epitopes are limited or avoided by, exchanging V region segments contributing to or encoding a T cell epitope with alternative segments which avoid T cell epitopes. This method is described in US 2008/0206239 A1.

Deimmunization

This method involves the removal of human (or other second species) T-cell epitopes from the V regions of the therapeutic antibody (or other molecule). The therapeutic antibodies V-region sequence is analysed for the presence of MHC class II-binding motifs by, for example, comparison with databases of MHC-binding motifs (such as the "motifs" database hosted at www.wehi.edu.au). Alternatively, MHC class II-binding motifs may be identified using computational threading methods such as those devised by Altuvia et al. (J. Mol. Biol. 249 244-250 (1995)); in these methods, consecutive overlapping peptides from the V-region sequences are testing for their binding energies to MHC class II proteins. This data can then be combined with information on other sequence features which relate to successfully presented peptides, such as amphipathicity, Rothbard motifs, and cleavage sites for cathepsin B and other processing enzymes.

Once potential second species (e.g. human) T-cell epitopes have been identified, they are eliminated by the alteration of one or more amino acids. The modified amino acids are usually within the T-cell epitope itself, but may also be adjacent to the epitope in terms of the primary or secondary structure of the protein (and therefore, may not be adjacent in the primary structure). Most typically, the alteration is by way of substitution but, in some circumstances amino acid addition or deletion will be more appropriate.

All alterations can be accomplished by recombinant DNA technology, so that the final molecule may be prepared by expression from a recombinant host using well established methods such as Site Directed Mutagenesis. However, the use of protein chemistry or any other means of molecular alteration is also possible.

Resurfacing

This method involves:

(a) determining the conformational structure of the variable region of the non-human (e.g. rodent) antibody (or fragment thereof) by constructing a three-dimensional model of the non-human antibody variable region;

(b) generating sequence alignments using relative accessibility distributions from x-ray crystallographic structures of a sufficient number of non-human and human antibody variable region heavy and light chains to give a set of heavy and light chain framework positions wherein the alignment positions are identical in 98% of the sufficient number of non-human antibody heavy and light chains;

(c) defining for the non-human antibody to be humanized, a set of heavy and light chain surface exposed amino acid residues using the set of framework positions generated in step (b);

(d) identifying from human antibody amino acid sequences a set of heavy and light chain surface exposed amino acid residues that is most closely identical to the set of surface exposed amino acid residues defined in step (c), wherein the heavy and light chain from the human antibody are or are not naturally paired;

(e) substituting, in the amino acid sequence of the non-human antibody to be humanized, the set of heavy and light chain surface exposed amino acid residues defined in step (c) with the set of heavy and light chain surface exposed amino acid residues identified in step (d);

(f) constructing a three-dimensional model of the variable region of the non-human antibody resulting from the substituting specified in step (e);

(g) identifying, by comparing the three-dimensional models constructed in steps (a) and (f), any amino acid residues from the sets identified in steps (c) or (d), that are within 5 Angstroms of any atom of any residue of the complementarity determining regions of the non-human antibody to be humanized; and (h) changing any residues identified in step (g) from the human to the original non-human amino acid residue to thereby define a non-human antibody humanizing set of surface exposed amino acid residues; with the proviso that step (a) need not be conducted first, but must be conducted prior to step (g).

Superhumanization

The method compares the non-human sequence with the functional human germline gene repertoire. Those human genes encoding canonical structures identical or closely related to the non-human sequences are selected. Those selected human genes with highest homology within the CDRs are chosen as FR donors. Finally, the non-human CDRs are grafted onto these human FRs. This method is described in patent WO 2005/079479 A2.

Human String Content Optimization

This method compares the non-human (e.g. mouse) sequence with the repertoire of human germline genes and the differences are scored as Human String Content (HSC) that quantifies a sequence at the level of potential MHC/T-cell epitopes. The target sequence is then humanized by maximizing its HSC rather than using a global identity measure to generate multiple diverse humanized variants (described in Molecular Immunology, 44, (2007) 1986-1998).

Framework Shuffling

The CDRs of the non-human antibody are fused in-frame to cDNA pools encompassing all known heavy and light chain human germline gene frameworks. Humanised antibodies are then selected by e.g. panning of the phage displayed antibody library. This is described in *Methods* 36, 43-60 (2005).

Examples of cell binding agents include those agents described for use in WO 2007/085930, which is incorporated herein.

Tumour-associate antigens and cognate antibodies for use in embodiments of the present invention are listed below.

Tumor-Associated Antigens and Cognate Antibodies (1) BMPR1B (Bone Morphogenetic Protein Receptor-Type IB)
Nucleotide
Genbank accession no. NM_001203
Genbank version no. NM_001203.2 GI:169790809
Genbank record update date: Sep. 23, 2012 02:06 PM
Polypeptide
Genbank accession no. NP 001194
Genbank version no. NP 001194.1 GI:4502431
Genbank record update date: Sep. 23, 2012 02:06 PM
Cross-References
ten Dijke, P., et al *Science* 264 (5155): 101-104 (1994), *Oncogene* 14 10 (11):1377-1382 (1997)); WO2004/063362 (Claim 2); WO2003/042661 (Claim 12); US2003/134790-A1 (Page 38-39); WO2002/102235 (Claim 13; Page 296); WO2003/055443 (Page 91-92); WO2002/99122 (Example 2; Page 528-530); WO2003/029421 (Claim 6); WO2003/024392 (Claim 2; FIG. 112); WO2002/98358 (Claim 1; Page 183); WO2002/54940 (Page 100-101); WO2002/59377 (Page 349-350); WO2002/30268 (Claim 27; Page 376); 15 WO2001/48204 (Example; FIG. 4); NP_001194 bone morphogenetic protein receptor, type IB/pid=NP_001194.1; MIM: 603248; AY065994

(2) E16 (LAT1, SLC7A5)
Nucleotide
Genbank accession no. NM_003486
Genbank version no. NM_003486.5 GI:71979931
Genbank record update date: Jun. 27, 2012 12:06 PM
Polypeptide
Genbank accession no. NP_003477
Genbank version no. NP_003477.4 GI:71979932
Genbank record update date: Jun. 27, 2012 12:06 PM
Cross References
*Biochem. Biophys. Res. Commun.* 255 (2), 283-288 (1999), *Nature* 395 (6699):288-291 (1998), Gaugitsch, H. W., et 20 al (1992) *J. Biol. Chem.* 267 (16):11267-11273); WO2004/048938 (Example 2); WO2004/032842 (Example IV); WO2003/042661 (Claim 12); WO2003/016475 (Claim 1); WO2002/78524 (Example 2); WO2002/99074 (Claim 19; Page 127-129); WO2002/86443 (Claim 27; Pages 222, 393); WO2003/003906 (Claim 10; Page 293); WO2002/64798 (Claim 33; Page 93-95); WO2000/14228 (Claim 5; Page 133-136); US2003/224454 (FIG. 3); 25 WO2003/025138 (Claim 12; Page 150); NP_003477 solute carrier family 7 (cationic amino
acid transporter, y+system), member 5/pid=NP_003477.3— *Homo sapiens*; MIM:600182; NM_015923.

(3) STEAP1 (Six Transmembrane Epithelial Antigen of Prostate)
Nucleotide
Genbank accession no. NM_012449
Genbank version no. NM_012449.2 GI:22027487
Genbank record update date: Sep. 9, 2012 02:57 PM
Polypeptide
Genbank accession no. NP_036581
Genbank version no. NP_036581.1 GI:9558759
Genbank record update date: Sep. 9, 2012 02:57 PM
Cross References
*Cancer Res.* 61 (15), 5857-5860 (2001), Hubert, R. S., et al (1999) *Proc. Natl. Acad. Sci. U.S.A.* 96 (25):14523-14528); WO2004/065577 (Claim 6); WO2004/027049 (FIG. 1L); EP1394274 (Example 11); WO2004/016225 (Claim 2); WO2003/042661 (Claim 12); US2003/157089 (Example 5); US2003/185830 (Example 5); US2003/064397 (FIG. 2); WO2002/89747 (Example 5; Page 618-619); WO2003/022995 (Example 9; FIG. 13A, Example 53; Page 173, Example 2; FIG. 2A); six transmembrane epithelial antigen of the prostate; MIM:604415.

(4) 0772P (CA125, MUC16)
Nucleotide
Genbank accession no. AF361486
Genbank version no. AF361486.3 GI:34501466
Genbank record update date: Mar. 11, 2010 07:56 AM
Polypeptide
Genbank accession no. AAK74120
Genbank version no. AAK74120.3 GI:34501467
Genbank record update date: Mar. 11, 2010 07:56 AM
Cross References
*J. Biol. Chem.* 276 (29):27371-27375 (2001)); WO2004/045553 (Claim 14); WO2002/92836 (Claim 6; FIG. 12); WO2002/83866 (Claim 15; Page 116-121); US2003/124140 (Example 16); GI:34501467;

(5) MPF (MPF, MSLN, SMR, Megakaryocyte Potentiating Factor, Mesothelin)
Nucleotide
Genbank accession no. NM_005823
Genbank version no. NM_005823.5 GI:293651528
Genbank record update date: Sep. 2, 2012 01:47 PM
Polypeptide
Genbank accession no. NP_005814
Genbank version no. NP_005814.2 GI:53988378
Genbank record update date: Sep. 2, 2012 01:47 PM
Cross References
Yamaguchi, N., et al *Biol. Chem.* 269 (2), 805-808 (1994), *Proc. Natl. Acad. Sci. U.S.A.* 96 (20):11531-11536 (1999), *Proc. Natl. Acad. Sci. U.S.A.* 93 10 (1):136-140 (1996), *J. Biol. Chem.* 270 (37):21984-21990 (1995)); WO2003/101283 (Claim 14); (WO2002/102235 (Claim 13; Page 287-288); WO2002/101075 (Claim 4; Page 308-309); WO2002/71928 (Page 320-321); WO94/10312 (Page 52-57); IM:601051.

(6) Napi3b (NAPI-3B, NPTIIb, SLC34A2, Solute Carrier Family 34 (Sodium Phosphate), Member 2, Type II Sodium-Dependent Phosphate Transporter 3b)
Nucleotide
Genbank accession no. NM_006424
Genbank version no. NM_006424.2 GI:110611905
Genbank record update date: Jul. 22, 2012 03:39 PM
Polypeptide
Genbank accession no. NP_006415
Genbank version no. NP_006415.2 GI:110611906
Genbank record update date: Jul. 22, 2012 03:39 PM
Cross References
*J. Biol. Chem.* 277 (22):19665-19672 (2002), *Genomics* 62 (2):281-284 (1999), Feild, J. A., et al (1999) *Biochem. Biophys. Res. Commun.* 258 (3):578-582); WO2004/022778 (Claim 2); EP1394274 (Example 11); WO2002/102235 (Claim 13; Page 20 326); EP0875569 (Claim 1; Page 17-19); WO2001/57188 (Claim 20; Page 329); WO2004/032842 (Example IV); WO2001/75177 (Claim 24; Page 139-140); MIM:604217.

(7) Sema 5b (FLJ10372, KIAA1445, Mm.42015, SEMA5B, SEMAG, Semaphorin 5b Hlog, 25 Sema Domain, Seven Thrombospondin Repeats (Type 1 and Type 1-Like), Transmembrane Domain™ and Short Cytoplasmic Domain, (Semaphorin) 5B)
Nucleotide
Genbank accession no. AB040878
Genbank version no. AB040878.1 GI:7959148
Genbank record update date: Aug. 2, 2006 05:40 PM
Polypeptide
Genbank accession no. BAA95969
Genbank version no. BAA95969.1 GI:7959149
Genbank record update date: Aug. 2, 2006 05:40 PM
Cross References
Nagase T., et al (2000) *DNA Res.* 7 (2):143-150); WO2004/000997 (Claim 1); WO2003/003984 (Claim 1); WO2002/06339 (Claim 1; Page 50); WO2001/88133 (Claim 1; Page 41-43, 48-58); WO2003/054152 (Claim 20); WO2003/101400 (Claim 11); Accession: 30 Q9P283; Genew; HGNC:10737

(8) PSCA hlg (2700050C12Rik, C530008016Rik, RIKEN cDNA 2700050C12, RIKEN cDNA 2700050C12 Gene)
Nucleotide
Genbank accession no. AY358628
Genbank version no. AY358628.1 GI:37182377
Genbank record update date: Dec. 1, 2009 04:15 AM
Polypeptide
Genbank accession no. AAQ88991
Genbank version no. AAQ88991.1 GI:37182378
Genbank record update date: Dec. 1, 2009 04:15 AM
Cross References
Ross et al (2002) *Cancer Res.* 62:2546-2553; US2003/129192 (Claim 2); US2004/044180 (Claim 12); US2004/044179 35 (Claim 11); US2003/096961 (Claim 11); US2003/232056 (Example 5); WO2003/105758 16 (Claim 12); US2003/206918 (Example 5); EP1347046 (Claim 1); WO2003/025148 (Claim 20); GI:37182378.

(9) ETBR (Endothelin Type B Receptor)
Nucleotide
Genbank accession no. AY275463
Genbank version no. AY275463.1 GI:30526094
Genbank record update date: Mar. 11, 2010 02:26 AM
Polypeptide
Genbank accession no. AAP32295
Genbank version no. AAP32295.1 GI:30526095
Genbank record update date: Mar. 11, 2010 02:26 AM
Cross References
Nakamuta M., et al *Biochem. Biophys. Res. Commun.* 177, 34-39, 1991; Ogawa Y., et al *Biochem. Biophys. Res. Commun.* 178, 248-255, 1991; Arai H., et al *Jpn. Circ. J.* 56, 1303-1307, 1992; Arai H., et al *J. Biol. Chem.* 268, 3463-3470, 1993; Sakamoto A., Yanagisawa M., et al *Biochem. Biophys. Res. Commun.* 178, 656-663, 1991; Elshourbagy N. A., et al *J. Biol. Chem.* 268, 3873-3879, 1993; Haendler B., et al *J. Cardiovasc. Pharmacol.* 20, s1-S4, 1992; Tsutsumi M., et al *Gene* 228, 43-49, 1999; Strausberg R. L., et al *Proc. Natl. Acad. Sci. U.S.A.* 99, 16899-16903, 2002; Bourgeois C., et al *J. Clin. Endocrinol. Metab.* 82, 3116-3123, 1997;
Okamoto Y., et al *Biol. Chem.* 272, 21589-21596, 1997; Verheij J. B., et al *Am. J. Med. Genet.* 108, 223-225, 2002; Hofstra R. M. W., et al *Eur. J. Hum. Genet.* 5, 180-185, 1997; Puffenberger E. G., et al *Cell* 79, 1257-1266, 1994; Attie T., et al, *Hum. Mol. Genet.* 4, 2407-15 2409, 1995; Auricchio A., et al *Hum. Mol. Genet.* 5:351-354, 1996; Amiel J., et al *Hum. Mol. Genet.* 5, 355-357, 1996; Hofstra R. M. W., et al *Nat. Genet.* 12, 445-447, 1996; Svensson P. J., et al *Hum. Genet.* 103, 145-148, 1998; Fuchs S., et al *Mol. Med.* 7, 115-124, 2001; Pingault V., et al (2002) *Hum. Genet.* 111, 198-206); WO2004/045516 (Claim 1); WO2004/048938 (Example 2); WO2004/040000 (Claim 151); WO2003/087768 (Claim 1); 20 WO2003/016475 (Claim 1); WO2003/016475 (Claim 1); WO2002/61087 (FIG. 1); WO2003/016494 (FIG. 6); WO2003/025138 (Claim 12; Page 144); WO2001/98351 (Claim 1; Page 124-125); EP0522868 (Claim 8; FIG. 2); WO2001/77172 (Claim 1; Page 297-299); US2003/109676; U.S. Pat. No. 6,518,404 (FIG. 3); U.S. Pat. No. 5,773,223 (Claim 1a; Col 31-34); WO2004/001004.

(10) MSG783 (RNF124, Hypothetical Protein FLJ20315)
Nucleotide
Genbank accession no. NM_017763
Genbank version no. NM_017763.4 GI:167830482
Genbank record update date: Jul. 22, 2012 12:34 AM
Polypeptide
Genbank accession no. NP_060233
Genbank version no. NP_060233.3 GI:56711322
Genbank record update date: Jul. 22, 2012 12:34 AM
Cross References
WO2003/104275 (Claim 1); WO2004/046342 (Example 2); WO2003/042661 (Claim 12); WO2003/083074 (Claim 14; Page 61); WO2003/018621 (Claim 1); WO2003/024392 (Claim 2; FIG. 93); WO2001/66689 (Example 6); LocusID:54894.

(11) STEAP2 (HGNC_8639, IPCA-1, PCANAP1, STAMP1, STEAP2, STMP, Prostate Cancer Associated Gene 1, Prostate Cancer Associated Protein 1, Six Transmembrane Epithelial Antigen of Prostate 2, Six Transmembrane Prostate Protein)
Nucleotide
Genbank accession no. AF455138
Genbank version no. AF455138.1 GI:22655487
Genbank record update date: Mar. 11, 2010 01:54 AM
Polypeptide
Genbank accession no. AAN04080
Genbank version no. AAN04080.1 GI:22655488
Genbank record update date: Mar. 11, 2010 01:54 AM
Cross References
Lab. Invest. 82 (11):1573-1582 (2002)); WO2003/087306; US2003/064397 (Claim 1; FIG. 1); WO2002/72596 (Claim 13; Page 54-55); WO2001/72962 (Claim 1; FIG. 4B); 35 WO2003/104270 (Claim 11); WO2003/104270 (Claim 16); US2004/005598 (Claim 22); WO2003/042661 (Claim 12); US2003/060612 (Claim 12; FIG. 10); WO2002/26822 (Claim 23; FIG. 2); WO2002/16429 (Claim 12; FIG. 10); GI:22655488.

(12) TrpM4 (BR22450, FLJ20041, TRPM4, TRPM4B, Transient Receptor Potential Cation 5 Channel, Subfamily M, Member 4)
Nucleotide
Genbank accession no. NM_017636
Genbank version no. NM_017636.3 GI:304766649
Genbank record update date: Jun. 29, 2012 11:27 AM
Polypeptide
Genbank accession no. NP_060106
Genbank version no. NP_060106.2 GI:21314671
Genbank record update date: Jun. 29, 2012 11:27 AM
Cross References
Xu, X. Z., et al *Proc. Natl. Acad. Sci. U.S.A.* 98 (19):10692-10697 (2001), *Cell* 109 (3):397-407 (2002), *J. Biol. Chem.* 278 (33):30813-30820 (2003)); US2003/143557 (Claim 4); WO2000/40614 (Claim 14; Page 100-103); WO2002/10382 (Claim 1; FIG. 9A); WO2003/042661 (Claim 12); WO2002/30268 (Claim 27; Page 391);

US2003/219806 (Claim 4); WO2001/62794 (Claim 10 14; FIG. 1A-D); MIM:606936.

(13) CRIPTO (CR, CR1, CRGF, CRIPTO, TDGF1, Teratocarcinoma-Derived Growth Factor)
Nucleotide
Genbank accession no. NM_003212
Genbank version no. NM_003212.3 GI:292494881
Genbank record update date: Sep. 23, 2012 02:27 PM
Polypeptide
Genbank accession no. NP_003203
Genbank version no. NP_003203.1 GI:4507425
Genbank record update date: Sep. 23, 2012 02:27 PM
Cross References
Ciccodicola, A., et al *EMBO J.* 8 (7):1987-1991 (1989), *Am. J. Hum. Genet.* 49 (3):555-565 (1991)); US2003/224411 (Claim 1); WO2003/083041 (Example 1); WO2003/034984 (Claim 12); WO2002/88170 (Claim 2; Page 52-53); WO2003/024392 (Claim 2; FIG. 58); WO2002/16413 (Claim 1; Page 94-95, 105); WO2002/22808 (Claim 2; FIG. 1); U.S. Pat. No. 5,854,399 (Example 2; Col 17-18); U.S. Pat. No. 5,792,616 (FIG. 2); MIM: 187395.

(14) CD21 (CR2 (Complement Receptor 2) or C3DR (C3d/ Epstein Barr Virus Receptor) or Hs.73792)
Nucleotide
Genbank accession no M26004
Genbank version no. M26004.1 GI:181939
Genbank record update date: Jun. 23, 2010 08:47 AM
Polypeptide
Genbank accession no. AAA35786
Genbank version no. AAA35786.1 GI:181940
Genbank record update date: Jun. 23, 2010 08:47 AM
Cross References
Fujisaku et al (1989) *J. Biol. Chem.* 264 (4):2118-2125); Weis J. J., et al *J. Exp. Med.* 167, 1047-1066, 1988; Moore M., et al *Proc. Natl. Acad. Sci. U.S.A.* 84, 9194-9198, 1987; Barel M., et al *Mol. Immunol.* 35, 1025-1031, 1998; Weis J. J., et al *Proc. Natl. Acad. Sci. U.S.A.* 83, 5639-5643, 1986; Sinha S. K., et al (1993) *J. Immunol.* 150, 5311-5320; WO2004/045520 (Example 4); US2004/005538 (Example 1); WO2003/062401 (Claim 9); WO2004/045520 (Example 4); WO91/02536 (FIGS. 9.1-9.9); WO2004/020595 (Claim 1); Accession: P20023; Q13866; Q14212; EMBL; M26004; AAA35786.1.

(15) CD79b (CD79B, CD79β, IGb (Immunoglobulin-Associated Beta), B29)
Nucleotide
Genbank accession no NM_000626
Genbank version no. NM_000626.2 GI:90193589
Genbank record update date: Jun. 26, 2012 01:53 PM
Polypeptide
Genbank accession no. NP_000617
Genbank version no. NP_000617.1 GI:11038674
Genbank record update date: Jun. 26, 2012 01:53 PM
Cross References
*Proc. Natl. Acad. Sci. U.S.A.* (2003) 100 (7):4126-4131, Blood (2002) 100 (9):3068-3076, Muller et al (1992) *Eur. J. Immunol.* 22 (6):1621-1625); WO2004/016225 (claim 2, FIG. 140); WO2003/087768, US2004/101874 (claim 1, page 102); WO2003/062401 (claim 9); WO2002/78524 (Example 2); US2002/150573 (claim 35 5, page 15); U.S. Pat. No. 5,644,033; WO2003/048202 (claim 1, pages 306 and 309); WO 99/58658, U.S. Pat. No. 6,534,482 (claim 13, FIG. 17A/B); WO2000/55351 (claim 11, pages 1145-1146); MIM:147245

(16) FcRH2 (IFGP4, IRTA4, SPAP1A (SH2 Domain Containing Phosphatase Anchor Protein 5 1a), SPAP1B, SPAP1C)
Nucleotide
Genbank accession no NM_030764
Genbank version no. NM_030764.3 GI:227430280
Genbank record update date: Jun. 30, 2012 12:30 AM
Polypeptide
Genbank accession no. NP_110391
Genbank version no. NP_110391.2 GI:19923629
Genbank record update date: Jun. 30, 2012 12:30 AM
Cross References
AY358130); *Genome Res.* 13 (10):2265-2270 (2003), *Immunogenetics* 54 (2):87-95 (2002), *Blood* 99 (8):2662-2669 (2002), *Proc. Natl. Acad. Sci. U.S.A.* 98 (17):9772-9777 (2001), Xu, M. J., et al (2001) *Biochem. Biophys. Res. Commun.* 280 (3):768-775; WO2004/016225 (Claim 2); WO2003/077836; WO2001/38490 (Claim 5; FIG. 18D-1-18D-2); WO2003/097803 (Claim 12); WO2003/089624 (Claim 25); MIM:606509.

(17) HER2 (ErbB2)
Nucleotide
Genbank accession no M11730
Genbank version no. M11730.1 GI:183986
Genbank record update date: Jun. 23, 2010 08:47 AM
Polypeptide
Genbank accession no. AAA75493
Genbank version no. AAA75493.1 GI:306840
Genbank record update date: Jun. 23, 2010 08:47 AM
Cross References
Coussens L., et al *Science* (1985) 230(4730):1132-1139); Yamamoto T., et al *Nature* 319, 230-234, 1986; Semba K., et al *Proc. Natl. Acad. Sci. U.S.A.* 82, 6497-6501, 1985; Swiercz J. M., et al *J. Cell Biol.* 165, 869-15 880, 2004; Kuhns J. J., et al *J. Biol. Chem.* 274, 36422-36427, 1999; Cho H.-S., et al *Nature* 421, 756-760, 2003; Ehsani A., et al (1993) *Genomics* 15, 426-429; WO2004/048938 (Example 2); WO2004/027049 (FIG. 11); WO2004/009622; WO2003/081210; WO2003/089904 (Claim 9); WO2003/016475 (Claim 1); US2003/118592; WO2003/008537 (Claim 1); WO2003/055439 (Claim 29; FIG. 1A-B); WO2003/025228 (Claim 37; FIG. 5C); 20 WO2002/22636 (Example 13; Page 95-107); WO2002/12341 (Claim 68; FIG. 7); WO2002/13847 (Page 71-74); WO2002/14503 (Page 114-117); WO2001/53463 (Claim 2; Page 41-46); WO2001/41787 (Page 15); WO2000/44899 (Claim 52; FIG. 7); WO2000/20579 (Claim 3; FIG. 2); U.S. Pat. No. 5,869,445 (Claim 3; Col 31-38); WO9630514 (Claim 2; Page 56-61); EP1439393 (Claim 7); WO2004/043361 (Claim 7); WO2004/022709; WO2001/00244 25 (Example 3; FIG. 4); Accession: P04626; EMBL; M11767; AAA35808.1. EMBL; M11761; AAA35808.1

Antibodies
Abbott: US20110177095
  For example, an antibody comprising CDRs having overall at least 80% sequence identity to CDRs having amino acid sequences of SEQ ID NO:3 (CDR-H1), SEQ ID NO:4 (CDR-H2), SEQ ID NO:5 (CDR-H3), SEQ ID NO:104 and/or SEQ ID NO:6 (CDR-L1), SEQ ID NO:7 (CDR-L2), and SEQ ID NO:8 (CDR-L3), wherein the anti-HER2 antibody or anti-HER2 binding fragment has reduced immunogenicity as compared to an antibody having a VH of SEQ ID NO:1 and a VL of SEQ ID NO:2.

Biogen: US20100119511
- For example, ATCC accession numbers: PTA-10355, PTA-10356, PTA-10357, PTA-10358
- For example, a purified antibody molecule that binds to HER2 comprising a all six CDR's from an antibody selected from the group consisting of BIIB71F10 (SEQ ID NOs:11, 13), BIIB69A09 (SEQ ID NOs:15, 17); BIIB67F10 (SEQ ID NOs:19, 21); BIIB67F11 (SEQ ID NOs:23, 25), BIIB66A12 (SEQ ID NOs:27, 29), BIIB66C01 (SEQ ID NOs:31, 33), BIIB65C10 (SEQ ID NOs:35, 37), BIIB65H09 (SEQ ID NOs:39, 41) and BIIB65B03 (SEQ ID NOs:43, 45), or CDRs which are identical or which have no more than two alterations from said CDRs.

Herceptin (Genentech)—U.S. Pat. No. 6,054,297; ATCC accession no. CRL-10463 (Genentech)

Pertuzumab (Genentech)
- US20110117097
  - for example, see SEQ IDs No. 15&16, SEQ IDs No. 17&18, SEQ IDs No. 23&24 & ATCC accession numbers HB-12215, HB-12216, CRL 10463, HB-12697.
- US20090285837
- US20090202546
  - for example, ATCC accession numbers: HB-12215, HB-12216, CRL 10463, HB-12698.
- US20060088523
  - for example, ATCC accession numbers: HB-12215, HB-12216
  - for example, an antibody comprising the variable light and variable heavy amino acid sequences in SEQ ID Nos. 3 and 4, respectively.
  - for example, an antibody comprising a light chain amino acid sequence selected from SEQ ID No. 15 and 23, and a heavy chain amino acid sequence selected from SEQ ID No. 16 and 24
- US20060018899
  - for example, ATCC accession numbers: (7C2) HB-12215, (7F3) HB-12216, (4D5) CRL-10463, (2C4) HB-12697.
  - for example, an antibody comprising the amino acid sequence in SEQ ID No. 23, or a deamidated and/or oxidized variant thereof.
- US2011/0159014
  - for example, an antibody having a light chain variable domain comprising the hypervariable regions of SEQ ID NO: 1".
  - For example, an antibody having a heavy chain variable domain comprising the hypervariable regions of SEQ ID NO: 2.
- US20090187007

Glycotope: TrasGEX antibody http://www.glycotope.com/pipeline
- For example, see International Joint Cancer Institute and Changhai Hospital Cancer Cent: HMTI-Fc Ab—Gao J., et al *BMB Rep.* 2009 Oct. 31; 42(10):636-41.

Symphogen: US20110217305

Union Stem Cell &Gene Engineering, China—Liu H Q., et al *Xi Bao Yu Fen Zi Mian YiXue Za Zhi.* 2010 May; 26(5):456-8.

(18) NCA (CEACAM6)
Nucleotide
Genbank accession no M18728
Genbank version no. M18728.1 GI:189084
Genbank record update date: Jun. 23, 2010 08:48 AM
Polypeptide
Genbank accession no. AAA59907
Genbank version no. AAA59907.1 GI:189085
Genbank record update date: Jun. 23, 2010 08:48 AM
Cross References
Barnett T., et al *Genomics* 3, 59-66, 1988; Tawaragi Y., et al *Biochem. Biophys. Res. Commun.* 150, 89-96, 1988; Strausberg R. L., et al *Proc. Natl. Acad. Sci. U.S.A.* 99:16899-16903, 2002; WO2004/063709; EP1439393 (Claim 7); WO2004/044178 (Example 4); WO2004/031238; WO2003/042661 (Claim 12); WO2002/78524 (Example 2); WO2002/86443 (Claim 27; Page 427); WO2002/60317 (Claim 2); Accession: P40199; Q14920; EMBL; M29541; AAA59915.1.
EMBL; M18728.

(19) MDP (DPEP1)
Nucleotide
Genbank accession no BC017023
Genbank version no. BC017023.1 GI:16877538
Genbank record update date: Mar. 6, 2012 01:00 PM
Polypeptide
Genbank accession no. AAH17023
Genbank version no. AAH17023.1 GI:16877539
Genbank record update date: Mar. 6, 2012 01:00 PM
Cross References
*Proc. Natl. Acad. Sci. U.S.A.* 99 (26):16899-16903 (2002)); WO2003/016475 (Claim 1); WO2002/64798 (Claim 33; Page 85-87); JP05003790 (FIG. 6-8); WO99/46284 (FIG. 9); MIM:179780.

(20) IL20R-alpha (IL20Ra, ZCYTOR7)
Nucleotide
Genbank accession no AF184971
Genbank version no. AF184971.1 GI:6013324
Genbank record update date: Mar. 10, 2010 10:00 PM
Polypeptide
Genbank accession no. AAF01320
Genbank version no. AAF01320.1 GI:6013325
Genbank record update date: Mar. 10, 2010 10:00 PM
Cross References
Clark H. F., et al *Genome Res.* 13, 2265-2270, 2003; Mungall A. J., et al *Nature* 425, 805-811, 2003; Blumberg H., et al *Cell* 104, 9-19, 2001; Dumoutier L., et al *J. Immunol.* 167, 3545-3549,
2001; Parrish-Novak J., et al *J. Biol. Chem.* 277, 47517-47523, 2002; Pletnev S., et al (2003) 10 *Biochemistry* 42:12617-12624; Sheikh F., et al (2004) *J. Immunol.* 172, 2006-2010; EP1394274 (Example 11); US2004/005320 (Example 5); WO2003/029262 (Page 74-75); WO2003/002717 (Claim 2; Page 63); WO2002/22153 (Page 45-47); US2002/042366 (Page 20-21); WO2001/46261 (Page 57-59); WO2001/46232 (Page 63-65); WO98/37193 (Claim 1; Page 55-59); Accession: Q9UHF4; Q6UWA9; Q96SH8; EMBL; AF184971; AAF01320.1.

(21) Brevican (BCAN, BEHAB)
Nucleotide
Genbank accession no AF229053
Genbank version no. AF229053.1 GI:10798902
Genbank record update date: Mar. 11, 2010 12:58 AM
Polypeptide
Genbank accession no. AAG23135
Genbank version no. AAG23135.1 GI:10798903
Genbank record update date: Mar. 11, 2010 12:58 AM
Cross References
Gary S. C., et al *Gene* 256, 139-147, 2000; Clark H. F., et al *Genome Res.* 13, 2265-2270, 2003; Strausberg R. L., et al *Proc. Natl. Acad. Sci. U.S.A.* 99, 16899-16903, 2002; US2003/186372 (Claim 11); US2003/186373 (Claim 11); US2003/119131 (Claim 1; FIG. 52); US2003/119122 (Claim 1; 20 FIG. 52); US2003/119126 (Claim 1);

US2003/119121 (Claim 1; FIG. 52); US2003/119129 (Claim 1); US2003/119130 (Claim 1); US2003/119128 (Claim 1; FIG. 52); US2003/119125 (Claim 1); WO2003/016475 (Claim 1); WO2002/02634 (Claim 1)

(22) EphB2R (DRT, ERK, Hek5, EPHT3, Tyro5)
Nucleotide
Genbank accession no NM_004442
Genbank version no. NM_004442.6 GI:111118979
Genbank record update date: Sep. 8, 2012 04:43 PM
Polypeptide
Genbank accession no. NP_004433
Genbank version no. NP_004433.2 GI:21396504
Genbank record update date: Sep. 8, 2012 04:43 PM
Cross References
Chan, J. and Watt, V. M., Oncogene 6 (6), 1057-1061 (1991) Oncogene 10 (5):897-905 (1995), Annu. Rev. Neurosci. 21:309-345 (1998), Int. Rev. Cytol. 196:177-244 (2000)); WO2003042661 (Claim 12); WO200053216 (Claim 1; Page 41); WO2004065576 (Claim 1); WO2004020583 (Claim 9); WO2003004529 (Page 128-132); WO200053216 (Claim 1; Page 42); MIM:600997.

(23) ASLG659 (B7h)
Nucleotide
Genbank accession no. AX092328
Genbank version no. AX092328.1 GI:13444478
Genbank record update date: Jan. 26, 2011 07:37 AM
Cross References
US2004/0101899 (Claim 2); WO2003104399 (Claim 11); WO2004000221 (FIG. 3); US2003/165504 (Claim 1); US2003/124140 (Example 2); US2003/065143 (FIG. 60); WO2002/102235 (Claim 13; Page 299); US2003/091580 (Example 2); WO2002/10187 (Claim 6; FIG. 10); WO2001/94641 (Claim 12; FIG. 7b); WO2002/02624 (Claim 13; FIG. 1A-1B); US2002/034749 (Claim 54; Page 45-46); WO2002/06317 (Example 2; Page 320-321, Claim 34; Page 321-322); WO2002/71928 (Page 468-469); WO2002/02587 (Example 1; FIG. 1); WO2001/40269 (Example 3; Pages 190-192); WO2000/36107 (Example 2; Page 205-207); WO2004/053079 (Claim 12); WO2003/004989 (Claim 1); WO2002/71928 (Page 233-234, 452-453); WO 01/16318.

(24) PSCA (Prostate Stem Cell Antigen Precursor)
Nucleotide
Genbank accession no AJ297436
Genbank version no. AJ297436.1 GI:9367211
Genbank record update date: Feb. 1, 2011 11:25 AM
Polypeptide
Genbank accession no. CAB97347
Genbank version no. CAB97347.1 GI:9367212
Genbank record update date: Feb. 1, 2011 11:25 AM
Cross References
Reiter R. E., et al *Proc. Natl. Acad. Sci. U.S.A.* 95, 1735-1740, 1998; Gu Z., et al *Oncogene* 19, 1288-1296, 2000; *Biochem. Biophys. Res. Commun.* (2000) 275(3):783-788; WO2004/022709; EP1394274 (Example 11); US2004/018553 (Claim 17); WO2003/008537 (Claim 1); WO2002/81646 (Claim 1; Page 164); WO2003/003906 (Claim 10; Page 288); WO2001/40309 (Example 1; FIG. 17); US2001/055751 (Example 1; FIG. 1b); WO2000/32752 (Claim 18; FIG. 1); WO98/51805 (Claim 17; Page 97); WO98/51824 (Claim 10; Page 94); WO98/40403 (Claim 2; FIG. 1B); Accession: 043653; EMBL; AF043498; AAC39607.1

(25) GEDA
Nucleotide
Genbank accession no AY260763
Genbank version no. AY260763.1 GI:30102448
Genbank record update date: Mar. 11, 2010 02:24 AM
Polypeptide
Genbank accession no. AAP14954
Genbank version no. AAP14954.1 GI:30102449
Genbank record update date: Mar. 11, 2010 02:24 AM
Cross References
AP14954 lipoma HMGIC fusion-partnerlike protein/pid=AAP14954.1—*Homo sapiens* (human); WO2003/054152 (Claim 20); WO2003/000842 (Claim 1); WO2003/023013 (Example 3, Claim 20); US2003/194704 (Claim 45); GI:30102449;

(26) BAFF-R (B Cell-Activating Factor Receptor, BLyS Receptor 3, BR3)
Nucleotide
Genbank accession no AF116456
Genbank version no. AF116456.1 GI:4585274
Genbank record update date: Mar. 10, 2010 09:44 PM
Polypeptide
Genbank accession no. AAD25356
Genbank version no. AAD25356.1 GI:4585275
Genbank record update date: Mar. 10, 2010 09:44 PM
Cross References
BAFF receptor/pid=NP_443177.1—*Homo sapiens*: Thompson, J. S., et al *Science* 293 (5537), 2108-2111 (2001); WO2004/058309; WO2004/011611; WO2003/045422 (Example; Page 32-33); WO2003/014294 (Claim 35; FIG. 6B); WO2003/035846 (Claim 70; Page 615-616); WO2002/94852 (Col 136-137); WO2002/38766 (Claim 3; Page 133); WO2002/24909 (Example 3; FIG. 3); MIM:606269; NP_443177.1; NM_052945_1; AF132600

(27) CD22 (B-Cell Receptor CD22-B Isoform, BL-CAM, Lyb-8, Lyb9, SIGLEC-2, FLJ22814)
Nucleotide
Genbank accession no AK026467
Genbank version no. AK026467.1 GI:10439337
Genbank record update date: Sep. 11, 2006 11:24 PM
Polypeptide
Genbank accession no. BAB15489
Genbank version no. BAB15489.1 GI:10439338
Genbank record update date: Sep. 11, 2006 11:24 PM
Cross References
Wilson et al (1991) *J. Exp. Med.* 173:137-146; 30 WO2003/072036 (Claim 1; FIG. 1); IM:107266; NP_001762.1; NM_001771_1.

(27a) CD22 (CD22 Molecule)
Nucleotide
Genbank accession no X52785
Genbank version no. X52785.1 GI:29778
Genbank record update date: Feb. 2, 2011 10:09 AM
Polypeptide
Genbank accession no. CAA36988
Genbank version no. CAA36988.1 GI:29779
Genbank record update date: Feb. 2, 2011 10:09 AM
Cross References
Stamenkovic I. et al., *Nature* 345 (6270), 74-77 (1990)??
Other Information
Official Symbol: CD22
Other Aliases: SIGLEC-2, SIGLEC2
Other Designations: B-cell receptor CD22; B-lymphocyte cell adhesion molecule; BL-CAM; CD22 antigen; T-cell surface antigen Leu-14; sialic acid binding Ig-like lectin 2; sialic acid-binding Ig-like lectin 2

Antibodies
G5/44 (Inotuzumab): DiJoseph J F., et al *Cancer Immunol Immunother.* 2005 January; 54(1):11-24.
Epratuzumab—Goldenberg D M., et al *Expert Rev Anticancer Ther.* 6(10): 1341-53, 2006.
(28) CD79a (CD79A, CD79alpha), Immunoglobulin-Associated Alpha, a B Cell-Specific Protein that Covalently Interacts with Ig Beta (CD79B) and Forms a Complex on the Surface with Ig M
35 Molecules, Transduces a Signal Involved in B-Cell Differentiation), Pl: 4.84, MW: 25028 TM: 2
[P] Gene Chromosome: 19q13.2).
Nucleotide
Genbank accession no NM_001783
Genbank version no. NM_001783.3 GI:90193587
Genbank record update date: Jun. 26, 2012 01:48 PM
Polypeptide
Genbank accession no. NP_001774
Genbank version no. NP_001774.1 GI:4502685
Genbank record update date: Jun. 26, 2012 01:48 PM
Cross References
WO2003/088808, US2003/0228319; WO2003/062401 (claim 9); US2002/150573 (claim 4, pages 13-14); WO99/58658 (claim 13, FIG. 16); WO92/07574 (FIG. 1); U.S. Pat. No. 5,644,033; Ha et al (1992) *J. Immunol.* 148(5):1526-1531; Müller et al (1992) *Eur. J. Immunol.* 22:1621-1625; Hashimoto et al (1994) *Immunogenetics* 40(4):287-295; Preud'homme et al (1992) *Clin. Exp. Immunol.* 90(1):141-146; Yu et al (1992) *J. Immunol.* 148(2) 633-637; Sakaguchi et al (1988) *EMBO J.* 7(11):3457-3464
(29) CXCR5 (Burkitt's Lymphoma Receptor 1, a G Protein-Coupled Receptor that is Activated by the CXCL13 Chemokine, Functions in Lymphocyte Migration and Humoral Defense, Plays a 10 Role in HIV-2 Infection and Perhaps Development of AIDS, Lymphoma, Myeloma, and Leukemia); 372 aa, pl: 8.54 MW: 41959 TM: 7 [P] Gene Chromosome: 11q23.3,
Nucleotide
Genbank accession no NM_001716
Genbank version no. NM_001716.4 GI:342307092
Genbank record update date: Sep. 30, 2012 01:49 PM
Polypeptide
Genbank accession no. NP_001707
Genbank version no. NP_001707.1 GI:4502415
Genbank record update date: Sep. 30, 2012 01:49 PM
Cross References
WO2004/040000; WO2004/015426; US2003/105292 (Example 2); U.S. Pat. No. 6,555,339 (Example 2); WO2002/61087 (FIG. 1); WO2001/57188 (Claim 20, page 269); WO2001/72830 (pages 12-13); WO2000/22129 (Example 1, pages 152-153, 15 Example 2, pages 254-256); WO99/28468 (claim 1, page 38); U.S. Pat. No. 5,440,021 (Example 2, col 49-52); WO94/28931 (pages 56-58); WO92/17497 (claim 7, FIG. 5); Dobner et al (1992) *Eur. J. Immunol.* 22:2795-2799; Barella et al (1995) *Biochem. J.* 309:773-779
(30) HLA-DOB (Beta Subunit of MHC Class II Molecule (La Antigen) that Binds Peptides and 20 Presents them to CD4+ T Lymphocytes); 273 aa, pl: 6.56, MW: 30820. TM: 1 [P] Gene Chromosome: 6p21.3)
Nucleotide
Genbank accession no NM_002120
Genbank version no. NM_002120.3 GI:118402587
Genbank record update date: Sep. 8, 2012 04:46 PM
Polypeptide
Genbank accession no. NP_002111
Genbank version no. NP_002111.1 GI:4504403
Genbank record update date: Sep. 8, 2012 04:46 PM
Cross References
Tonnelle et al (1985) *EMBO J.* 4(11):2839-2847; Jonsson et al (1989) *Immunogenetics* 29(6):411-413; Beck et al (1992) *J. Mol. Biol.* 228:433-441; Strausberg et al (2002) *Proc. Natl. Acad. Sci USA* 99:16899-16903; Servenius et al (1987) *J. Biol. Chem.* 262:8759-8766; Beck et al (1996) *J. Mol. Biol.* 25 255:1-13; Naruse et al (2002) *Tissue Antigens* 59:512-519; WO99/58658 (claim 13, FIG. 15); U.S. Pat. No. 6,153,408 (Col 35-38); U.S. Pat. No. 5,976,551 (col 168-170); U.S. Pat. No. 6,011,146 (col 145-146); Kasahara et al (1989) *Immunogenetics* 30(1): 66-68; Larhammar et al (1985) *J. Biol. Chem.* 260(26): 14111-14119
(31) P2X5 (Purinergic Receptor P2X Ligand-Gated Ion Channel 5, an Ion Channel Gated by Extracellular ATP, May be Involved in Synaptic Transmission and Neurogenesis, Deficiency May Contribute to the Pathophysiology of Idiopathic Detrusor Instability); 422 aa, pl: 7.63, MW: 47206 TM: 1 [P] Gene Chromosome: 17p13.3).
Nucleotide
Genbank accession no NM_002561
Genbank version no. NM_002561.3 GI:325197202
Genbank record update date: Jun. 27, 2012 12:41 AM
Polypeptide
Genbank accession no. NP_002552
Genbank version no. NP_002552.2 GI:28416933
Genbank record update date: Jun. 27, 2012 12:41 AM
Cross References
Le et al (1997) *FEBS Lett.* 418(1-2):195-199; WO2004/047749; WO2003/072035 (claim 10); Touchman et al (2000) *Genome Res.* 10:165-173; WO2002/22660 (claim 20); WO2003/093444 (claim 1); WO2003/087768 (claim 1); WO2003/029277 (page 82)
(32) CD72 (B-Cell Differentiation Antigen CD72, Lyb-2); 359 aa, pl: 8.66, MW: 40225, TM: 1 5 [P] Gene Chromosome: 9p13.3).
Nucleotide
Genbank accession no NM_001782
Genbank version no. NM_001782.2 GI:194018444
Genbank record update date: Jun. 26, 2012 01:43 PM
Polypeptide
Genbank accession no. NP_001773
Genbank version no. NP_001773.1 GI:4502683
Genbank record update date: Jun. 26, 2012 01:43 PM
Cross References
WO2004042346 (claim 65); WO2003/026493 (pages 51-52, 57-58); WO2000/75655 (pages 105-106); Von Hoegen et al (1990) *J. Immunol.* 144(12):4870-4877; Strausberg et al (2002) *Proc. Natl. Acad. Sci USA* 99:16899-16903.
(33) LY64 (Lymphocyte Antigen 64 (RP105), Type I Membrane Protein of the Leucine Rich Repeat (LRR) Family, Regulates B-Cell Activation and Apoptosis, Loss of Function is Associated with Increased Disease Activity in Patients with Systemic Lupus Erythematosis); 661 aa, pl: 6.20, MW: 74147 TM: 1 [P] Gene Chromosome: 5q12).
Nucleotide
Genbank accession no NM_005582
Genbank version no. NM_005582.2 GI:167555126
Genbank record update date: Sep. 2, 2012 01:50 PM
Polypeptide
Genbank accession no. NP_005573
Genbank version no. NP_005573.2 GI:167555127
Genbank record update date: Sep. 2, 2012 01:50 PM Cross References
US2002/193567; WO97/07198 (claim 11, pages 39-42); Miura et al (1996) 15 *Genomics* 38(3):299-304; Miura et al (1998) *Blood* 92:2815-2822; WO2003/083047; WO97/44452 (claim 8, pages 57-61); WO2000/12130 (pages 24-26).

(34) FcRH1 (Fc Receptor-Like Protein 1, a Putative Receptor for the Immunoglobulin Fc Domain that Contains C2 Type Ig-Like and ITAM Domains, May have a Role in B-Lymphocyte 20 Differentiation); 429 aa, pI: 5.28, MW: 46925 TM: 1 [P] Gene Chromosome: 1q21-1q22)
Nucleotide
Genbank accession no NM_052938
Genbank version no. NM_052938.4 GI:226958543
Genbank record update date: Sep. 2, 2012 01:43 PM
Polypeptide
Genbank accession no. NP_443170
Genbank version no. NP_443170.1 GI:16418419
Genbank record update date: Sep. 2, 2012 01:43 PM
Cross References
WO2003/077836; WO2001/38490 (claim 6, FIG. 18E-1-18-E-2); Davis et al (2001) *Proc. Natl. Acad. Sci USA* 98(17):9772-9777; WO2003/089624 (claim 8); EP1347046 (claim 1); WO2003/089624 (claim 7).

(35) IRTA2 (Immunoglobulin Superfamily Receptor Translocation Associated 2, a Putative Immunoreceptor with Possible Roles in B Cell Development and Lymphomagenesis; Deregulation of the Gene by Translocation Occurs in Some B Cell Malignancies); 977 aa, pI: 6.88, MW: 106468, TM: 1 [P] Gene Chromosome: 1q21)
Nucleotide
Genbank accession no AF343662
Genbank version no. AF343662.1 GI:13591709
Genbank record update date: Mar. 11, 2010 01:16 AM
Polypeptide
Genbank accession no. AAK31325
Genbank version no. AAK31325.1 GI:13591710
Genbank record update date: Mar. 11, 2010 01:16 AM
Cross References
AF343663, AF343664, AF343665, AF369794, AF397453, AK090423, AK090475, AL834187, AY358085; Mouse: AK089756, AY158090, AY506558; NP_112571.1; WO2003/024392 (claim 2, FIG. 97); Nakayama et al (2000) *Biochem. Biophys. Res. Commun.* 277(1):124-127; WO2003/077836; WO2001/38490 (claim 3, FIG. 18B-1-18B-2).

(36) TENB2 (TMEFF2, Tomoregulin, TPEF, HPP1, TR, Putative Transmembrane 35 Proteoglycan, Related to the EGF/Heregulin Family of Growth Factors and Follistatin); 374 aa)
Nucleotide
Genbank accession no AF179274
Genbank version no. AF179274.2 GI:12280939
Genbank record update date: Mar. 11, 2010 01:05 AM
Polypeptide
Genbank accession no. AAD55776
Genbank version no. AAD55776.2 GI:12280940
Genbank record update date: Mar. 11, 2010 01:05 AM
Cross References
NCBI Accession: AAD55776, AAF91397, AAG49451, NCBI RefSeq: NP_057276; NCBI Gene: 23671; OMIM: 605734; SwissProt Q9UIK5; AY358907, CAF85723, CQ782436; WO2004/074320; JP2004113151; WO2003/042661; WO2003/009814; EP1295944 (pages 69-70); WO2002/30268 (page 329); WO2001/90304; US2004/249130; US2004/022727; WO2004/063355; US2004/197325; US2003/232350; 5 US2004/005563; US2003/124579; Horie et al (2000) *Genomics* 67:146-152; Uchida et al (1999) *Biochem. Biophys. Res. Commun.* 266:593-602; Liang et al (2000) *Cancer Res.* 60:4907-12; Glynne-Jones et al (2001) *Int J Cancer*. October 15; 94(2):178-84.

(37) PSMA—FOLH1 (Folate Hydrolase (Prostate-Specific Membrane Antigen) 1)
Nucleotide
Genbank accession no M99487
Genbank version no. M99487.1 GI:190663
Genbank record update date: Jun. 23, 2010 08:48 AM
Polypeptide
Genbank accession no. AAA60209
Genbank version no. AAA60209.1 GI:190664
Genbank record update date: Jun. 23, 2010 08:48 AM
Cross References
Israeli R. S., et al *Cancer Res.* 53 (2), 227-230 (1993)
Other Information
Official Symbol: FOLH1
Other Aliases: GIG27, FGCP, FOLH, GCP2, GCPII, NAALAD1, NAALAdase, PSM, PSMA, mGCP
Other Designations: N-acetylated alpha-linked acidic dipeptidase 1; N-acetylated-alpha-linked acidic dipeptidase I; NAALADase I; cell growth-inhibiting gene 27 protein; folylpoly-gamma-glutamate carboxypeptidase; glutamate carboxylase II; glutamate carboxypeptidase 2; glutamate carboxypeptidase II; membrane glutamate carboxypeptidase; prostate specific membrane antigen variant F; pteroylpoly-gamma-glutamate carboxypeptidase
Antibodies
U.S. Pat. No. 7,666,425:
Antibodies produces by Hybridomas having the following ATCC references: ATCC accession No. HB-12101, ATCC accession No. HB-12109, ATCC accession No. HB-12127 and ATCC accession No. HB-12126.
Proscan: a monoclonal antibody selected from the group consisting of 8H12, 3E11, 17G1, 29B4, 30C1 and 20F2 (U.S. Pat. No. 7,811,564; Moffett S., et al *Hybridoma (Larchmt)*. 2007 Dec.; 26(6):363-72).
Cytogen: monoclonal antibodies 7E11-C5 (ATCC accession No. HB 10494) and 9H10-A4 (ATCC accession No. HB11430)—U.S. Pat. No. 5,763,202
GlycoMimetics: NUH2—ATCC accession No. HB 9762 (U.S. Pat. No. 7,135,301)
Human Genome Science: HPRAJ70—ATCC accession No. 97131 (U.S. Pat. No. 6,824,993); Amino acid sequence encoded by the cDNA clone (HPRAJ70) deposited as American Type Culture Collection ("ATCC") Deposit No. 97131
Medarex: Anti-PSMA antibodies that lack fucosyl residues—U.S. Pat. No. 7,875,278
Mouse anti-PSMA antibodies include the 3F5.4G6, 3D7.1.1, 4E10-1.14, 3E11, 4D8, 3E6, 3C9, 2C7, 1G3, 3C4, 3C6, 4D4, 1G9, 5C8B9, 3G6, 4C8B9, and monoclonal antibodies. Hybridomas secreting 3F5.4G6, 3D7.1.1, 4E10-1.14, 3E11, 4D8, 3E6, 3C9, 2C7, 1G3, 3C4, 3C6, 4D4, 1G9, 5C8B9, 3G6 or 4C8B9 have been publicly deposited and are described in U.S. Pat. No. 6,159,508. Relevant hybridomas have been publicly deposited and are described in U.S. Pat. No. 6,107,090. Moreover, humanized anti-PSMA antibodies, including a humanized version of J591, are described in further detail in PCT Publication WO 02/098897.

Other mouse anti-human PSMA antibodies have been described in the art, such as mAb 107-1A4 (Wang, S. et al. (2001) Int. J. Cancer 92:871-876) and mAb 2C9 (Kato, K. et al. (2003) Int. J. Urol. 10:439-444).

Examples of human anti-PSMA monoclonal antibodies include the 4A3, 7F12, 8C12, 8A11, 16F9, 2A10, 2C6, 2F5 and 1C3 antibodies, isolated and structurally characterized as originally described in PCT Publications WO 01/09192 and WO 03/064606 and in U.S. Provisional Application Ser. No. 60/654,125, entitled "Human Monoclonal Antibodies to Prostate Specific Membrane Antigen (PSMA)", filed on Feb. 18, 2005. The V.sub.H amino acid sequences of 4A3, 7F12, 8C12, 8A11, 16F9, 2A10, 2C6, 2F5 and 1C3 are shown in SEQ ID NOs: 1-9, respectively. The V.sub.L amino acid sequences of 4A3, 7F12, 8C12, 8A11, 16F9, 2A10, 2C6, 2F5 and 1C3 are shown in SEQ ID NOs: 10-18, respectively.

Other human anti-PSMA antibodies include the antibodies disclosed in PCT Publication WO 03/034903 and US Application No. 2004/0033229.

NW Biotherapeutics: A hybridoma cell line selected from the group consisting of 3F5.4G6 having ATCC accession number HB12060, 3D7-1.I. having ATCC accession number HB12309, 4E10-1.14 having ATCC accession number HB12310, 3E11 (ATCC HB12488), 4D8 (ATCC HB12487), 3E6 (ATCC HB12486), 3C9 (ATCC HB12484), 2C7 (ATCC HB12490), 1G3 (ATCC HB12489), 3C4 (ATCC HB12494), 3C6 (ATCC HB12491), 4D4 (ATCC HB12493), 1G9 (ATCC HB12495), 5C8B9 (ATCC HB12492) and 3G6 (ATCC HB12485)—see U.S. Pat. No. 6,150,508

PSMA Development Company/Progenics/Cytogen—Seattle Genetics: mAb 3.9, produced by the hybridoma deposited under ATCC Accession No. PTA-3258 or mAb 10.3, produced by the hybridoma deposited under ATCC Accession No. PTA-3347—U.S. Pat. No. 7,850,971

PSMA Development Company—Compositions of PSMA antibodies (US 20080286284, Table 1)
  This application is a divisional of U.S. patent application Ser. No. 10/395,894, filed on Mar. 21, 2003 (U.S. Pat. No. 7,850,971)

University Hospital Freiburg, Germany—mAbs 3/A12, 3/E7, and 3/F11 (Wolf P., et al Prostate. 2010 Apr. 1; 70(5):562-9).

(38) SST (Somatostatin Receptor; Note that there are 5 Subtypes)
(38.1) SSTR2 (Somatostatin Receptor 2)
Nucleotide
Genbank accession no NM_001050
Genbank version no. NM_001050.2 GI:44890054
Genbank record update date: Aug. 19, 2012 01:37 PM
Polypeptide
Genbank accession no. NP_001041
Genbank version no. NP_001041.1 GI:4557859
Genbank record update date: Aug. 19, 2012 01:37 PM
Cross References
Yamada Y., et al Proc. Natl. Acad. Sci. U.S.A. 89 (1), 251-255 (1992); Susini C., et al Ann Oncol. 2006 Dec.; 17(12):1733-42
Other Information
Official Symbol: SSTR2
Other Designations: SRIF-1; SS2R; somatostatin receptor type 2
(38.2) SSTR5 (Somatostatin Receptor 5)
Nucleotide
Genbank accession no D16827
Genbank version no. D16827.1 GI:487683
Genbank record update date: Aug. 1, 2006 12:45 PM
Polypeptide
Genbank accession no. BAA04107
Genbank version no. BAA04107.1 GI:487684
Genbank record update date: Aug. 1, 2006 12:45 PM
Cross References
Yamada, Y., et al Biochem. Biophys. Res. Commun. 195 (2), 844-852 (1993)
Other Information
Official Symbol: SSTR5
Other Aliases: SS-5-R
Other Designations: Somatostatin receptor subtype 5; somatostatin receptor type 5
(38.3) SSTR1
(38.4) SSTR3
(38.5) SSTR4
AvB6—Both Subunits (39+40)
(39) ITGAV (Integrin, Alpha V;
Nucleotide
Genbank accession no M14648 J02826 M18365
Genbank version no. M14648.1 GI:340306
Genbank record update date: Jun. 23, 2010 08:56 AM
Polypeptide
Genbank accession no. AAA36808
Genbank version no. AAA36808.1 GI:340307
Genbank record update date: Jun. 23, 2010 08:56 AM
Cross References
Suzuki S., et al Proc. Natl. Acad. Sci. U.S.A. 83 (22), 8614-8618 (1986)
Other Information
Official Symbol: ITGAV
Other Aliases: CD51, MSK8, VNRA, VTNR
Other Designations: antigen identified by monoclonal antibody L230; integrin alpha-V; integrin alphaVbeta3; integrin, alpha V (vitronectin receptor, alpha polypeptide, antigen CD51); vitronectin receptor subunit alpha
(40) ITGB6 (Integrin, Beta 6)
Nucleotide
Genbank accession no NM_000888
Genbank version no. NM_000888.3 GI:9966771
Genbank record update date: Jun. 27, 2012 12:46 AM
Polypeptide
Genbank accession no. NP_000879
Genbank version no. NP_000879.2 GI:9625002
Genbank record update date: Jun. 27, 2012 12:46 AM
Cross References
Sheppard D. J., et al Biol. Chem. 265 (20), 11502-11507 (1990)
Other Information
Official Symbol: ITGB6
Other Designations: integrin beta-6
Antibodies
Biogen: U.S. Pat. No. 7,943,742—Hybridoma clones 6.3G9 and 6.8G6 were deposited with the ATCC, accession numbers ATCC PTA-3649 and -3645, respectively.
Biogen: U.S. Pat. No. 7,465,449—In some embodiments, the antibody comprises the same heavy and light chain polypeptide sequences as an antibody produced by hybridoma 6.1A8, 6.3G9, 6.8G6, 6.2B1, 6.2B10, 6.2A1, 6.2E5, 7.1G10, 7.7G5, or 7.1C5.
Centocor (J&J): U.S. Pat. No. 7,550,142; U.S. Pat. No. 7,163,681
  For example in U.S. Pat. No. 7,550,142—an antibody having human heavy chain and human light chain variable regions comprising the amino acid sequences shown in SEQ ID NO: 7 and SEQ ID NO: 8.
Seattle Genetics: 15H3 (Ryan M C., et al Cancer Res Apr. 15, 2012; 72(8 Supplement): 4630)

(41) CEACAM5 (Carcinoembryonic Antigen-Related Cell Adhesion Molecule 5)
Nucleotide
Genbank accession no M17303
Genbank version no. M17303.1 GI:178676
Genbank record update date: Jun. 23, 2010 08:47 AM
Polypeptide
Genbank accession no. AAB59513
Genbank version no. AAB59513.1 GI:178677
Genbank record update date: Jun. 23, 2010 08:47 AM
Cross References
Beauchemin N., et al *Mol. Cell. Biol.* 7 (9), 3221-3230 (1987)
Other Information
Official Symbol: CEACAM5
Other Aliases: CD66e, CEA
Other Designations: meconium antigen 100
Antibodies
AstraZeneca-MedImmune: US 20100330103; US20080057063; US20020142359
  for example an antibody having complementarity determining regions (CDRs) with the following sequences: heavy chain; CDR1—DNYMH, CDR2—WIDPENGDTE YAPKFRG, CDR3—LIYAGYLAMD Y; and light chain CDR1—SASSSVTYMH, CDR2—STSNLAS, CDR3—QQRSTYPLT.
  Hybridoma 806.077 deposited as European Collection of Cell Cultures (ECACC) deposit no. 96022936.
Research Corporation Technologies, Inc.: U.S. Pat. No. 5,047,507
Bayer Corporation: U.S. Pat. No. 6,013,772
BioAlliance: U.S. Pat. No. 7,982,017; U.S. Pat. No. 7,674,605
  U.S. Pat. No. 7,674,605
    an antibody comprising the heavy chain variable region sequence from the amino acid sequence of SEQ ID NO: 1, and the light chain variable region sequence from the amino acid sequence of SEQ ID NO:2.
    an antibody comprising the heavy chain variable region sequence from the amino acid sequence of SEQ ID NO:5, and the light chain variable region sequence from the amino acid sequence of SEQ ID NO:6.
Celltech Therapeutics Limited: U.S. Pat. No. 5,877,293
The Dow Chemical Company: U.S. Pat. No. 5,472,693; U.S. Pat. No. 6,417,337; U.S. Pat. No. 6,333,405
  U.S. Pat. No. 5,472,693—for example, ATCC No. CRL-11215
  U.S. Pat. No. 6,417,337—for example, ATCC CRL-12208
  U.S. Pat. No. 6,333,405—for example, ATCC CRL-12208
Immunomedics, Inc: U.S. Pat. No. 7,534,431; U.S. Pat. No. 7,230,084; U.S. Pat. No. 7,300,644; U.S. Pat. No. 6,730,300;
  US20110189085
    an antibody having CDRs of the light chain variable region comprise: CDR1 comprises KASQDVGTSVA (SEQ ID NO: 20); CDR2 comprises WTSTRHT (SEQ ID NO: 21); and CDR3 comprises QQYSLYRS (SEQ ID NO: 22);
    and the CDRs of the heavy chain variable region of said anti-CEA antibody comprise: CDR1 comprises TYWMS (SEQ ID NO: 23); CDR2 comprises EIHPDSSTINYAPSLKD (SEQ ID NO: 24); and CDR3 comprises LYFGFPWFAY (SEQ ID NO: 25).
  US20100221175; US20090092598; US20070202044; US20110064653; US20090185974; US20080069775.

(42) MET (Met Proto-Oncogene; Hepatocyte Growth Factor Receptor)
Nucleotide
Genbank accession no M35073
Genbank version no. M35073.1 GI:187553
Genbank record update date: Mar. 6, 2012 11:12 AM
Polypeptide
Genbank accession no. AAA59589
Genbank version no. AAA59589.1 GI:553531
Genbank record update date: Mar. 6, 2012 11:12 AM
Cross References
Dean M., et al *Nature* 318 (6044), 385-388 (1985)
Other Information
Official Symbol: MET
Other Aliases: AUTS9, HGFR, RCCP2, c-Met
Other Designations: HGF receptor; HGF/SF receptor; SF receptor; hepatocyte growth factor receptor; met protooncogene tyrosine kinase; proto-oncogene c-Met; scatter factor receptor; tyrosine-protein kinase Met
Antibodies
Abgenix/Pfizer: US20100040629
  for example, the antibody produced by hybridoma 13.3.2 having American Type Culture Collection (ATCC) accession number PTA-5026; the antibody produced by hybridoma 9.1.2 having ATCC accession number PTA-5027; the antibody produced by hybridoma 8.70.2 having ATCC accession number PTA-5028; or the antibody produced by hybridoma 6.90.3 having ATCC accession number PTA-5029.
Amgen/Pfizer: US20050054019
  for example, an antibody comprising a heavy chain having the amino acid sequences set forth in SEQ ID NO: 2 where X2 is glutamate and X4 is serine and a light chain having the amino acid sequence set forth in SEQ ID NO: 4 where X8 is alanine, without the signal sequences; an antibody comprising a heavy chain having the amino acid sequences set forth in SEQ ID NO: 6 and a light chain having the amino acid sequence set forth in SEQ ID NO: 8, without the signal sequences; an antibody comprising a heavy chain having the amino acid sequences set forth in SEQ ID NO: 10 and a light chain having the amino acid sequence set forth in SEQ ID NO: 12, without the signal sequences; or an antibody comprising a heavy chain having the amino acid sequences set forth in SEQ ID NO: 14 and a light chain having the amino acid sequence set forth in SEQ ID NO: 16, without the signal sequences.
Agouron Pharmaceuticals (Now Pfizer): US20060035907
Eli Lilly: US20100129369
Genentech: U.S. Pat. No. 5,686,292; US20100028337; US20100016241; US20070129301; US20070098707; US20070092520, US20060270594; US20060134104; US20060035278; US20050233960; US20050037431
  U.S. Pat. No. 5,686,292—for example, ATCC HB-11894 and ATCC HB-11895
  US 20100016241—for example, ATCC HB-11894 (hybridoma 1A3.3.13) or HB-11895 (hybridoma 5D5.11.6)
National Defense Medical Center, Taiwan: Lu R M., et al *Biomaterials.* 2011 April; 32(12):3265-74.
Novartis: US20090175860
  for example, an antibody comprising the sequences of CDR1, CDR2 and CDR3 of heavy chain 4687, wherein the sequences of CDR1, CDR2, and CDR3 of heavy chain 4687 are residues 26-35, 50-65, and 98-102, respectively, of SEQ ID NO: 58; and the sequences of CDR1, CDR2, and CDR3 of light chain 5097, wherein the sequences of CDR1, CDR2, and CDR3 of light chain 5097 are residues 24-39, 55-61, and 94-100 of SEQ ID NO: 37.
Pharmacia Corporation: US20040166544
Pierre Fabre: US20110239316, US20110097262, US20100115639
Sumsung: US 20110129481—for example a monoclonal antibody produced from a hybridoma cell having accession number KCLRF-BP-00219 or accession number of KCLRF-BP-00223.
Samsung: US 20110104176—for example an antibody produced by a hybridoma cell having Accession Number: KCLRF-BP-00220.
University of Turin Medical School: DN-30 Pacchiana G., et al *J Biol Chem.* 2010 Nov. 12; 285(46):36149-57
Van Andel Research Institute: Jiao Y., et al *Mol Biotechnol.* 2005 Sep.; 31(1):41-54.
(43) MUC1 (Mucin 1, Cell Surface Associated)
Nucleotide
Genbank accession no J05581
Genbank version no. J05581.1 GI:188869
Genbank record update date: Jun. 23, 2010 08:48 AM
Polypeptide
Genbank accession no. AAA59876
Genbank version no. AAA59876.1 GI:188870
Genbank record update date: Jun. 23, 2010 08:48 AM
Cross References
Gendler S. J., et al *J. Biol. Chem.* 265 (25), 15286-15293 (1990)
Other Information
Official Symbol: MUC1
Other Aliases: RP11-263K19.2, CD227, EMA, H23AG, KL-6, MAM6, MUC-1, MUC-1/SEC, MUC-1/X, MUC1/ZD, PEM, PEMT, PUM
Other Designations: DF3 antigen; H23 antigen; breast carcinoma-associated antigen DF3; carcinoma-associated mucin; episialin; krebs von den Lungen-6; mucin 1, transmembrane; mucin-1; peanut-reactive urinary mucin; polymorphic epithelial mucin; tumor associated epithelial mucin; tumor-associated epithelial membrane antigen; tumor-associated mucin
Antibodies
AltaRex—Quest Pharma Tech: U.S. Pat. No. 6,716,966—for example an Alt-1 antibody produced by the hybridoma ATCC No PTA-975.
AltaRex—Quest Pharma Tech: U.S. Pat. No. 7,147,850
CRT: 5E5—Sorensen A L., et al *Glycobiology* vol. 16 no. 2 pp. 96-107, 2006; HMFG2—Burchell J., et al *Cancer Res.*, 47, 5476-5482 (1987)
Glycotope GT-MAB: GT-MAB 2.5-GEX (Website: http://www.glycotope.com/pipeline/pankomab-gex)
Immunogen: U.S. Pat. No. 7,202,346
for example, antibody MJ-170: hybridoma cell line MJ-170 ATCC accession no. PTA-5286Monoclonal antibody MJ-171: hybridoma cell line MJ-171 ATCC accession no. PTA-5287; monoclonal antibody MJ-172: hybridoma cell line MJ-172 ATCC accession no. PTA-5288; or monoclonal antibody MJ-173: hybridoma cell line MJ-173 ATCC accession no. PTA-5302
Immunomedics: U.S. Pat. No. 6,653,104
Ramot Tel Aviv Uni: U.S. Pat. No. 7,897,351
Regents Uni. CA: U.S. Pat. No. 7,183,388; US20040005647; US20030077676.
Roche GlycArt: U.S. Pat. No. 8,021,856
Russian National Cancer Research Center: Imuteran—Ivanov P K., et al *Biotechnol J.* 2007 Jul.; 2(7):863-70
Technische Univ Braunschweig: (IIB6, HT186-B7, HT186-D11, HT186-G2, HT200-3A-C1, HT220-M-D1, HT220-M-G8)—Thie H., et al *PLoS One.* 2011 Jan. 14; 6(1): e15921
(44) CA9 (Carbonic Anhydrase IX)
Nucleotide
Genbank accession no. X66839
Genbank version no. X66839.1 GI:1000701
Genbank record update date: Feb. 2, 2011 10:15 AM
Polypeptide
Genbank accession no. CAA47315
Genbank version no. CAA47315.1 GI:1000702
Genbank record update date: Feb. 2, 2011 10:15 AM
Cross References
Pastorek J., et al *Oncogene* 9 (10), 2877-2888 (1994)
Other Information
Official Symbol: CA9
Other Aliases: CAIX, MN
Other Designations: CA-IX; P54/58N; RCC-associated antigen G250; RCC-associated protein G250; carbonate dehydratase IX; carbonic anhydrase 9; carbonic dehydratase; membrane antigen MN; pMW1; renal cell carcinoma-associated antigen G250
Antibodies
Abgenix/Amgen: US20040018198
Affibody: Anti-CAIX Affibody molecules (http://www.affibody.com/en/Product-Portfolio/Pipeline/)
Bayer: U.S. Pat. No. 7,462,696
Bayer/Morphosys: 3ee9 mAb—Petrul H M., et al *Mol Cancer Ther.* 2012 Feb.; 11(2):340-9
Harvard Medical School: Antibodies G10, G36, G37, G39, G45, G57, G106, G119, G6, G27, G40 and G125. Xu C., et al *PLoS One.* 2010 Mar. 10; 5(3):e9625
Institute of Virology, Slovak Academy of Sciences (Bayer)—U.S. Pat. No. 5,955,075
for example, M75—ATCC Accession No. HB 11128 or MN12—ATCC Accession No. HB 11647
Institute of Virology, Slovak Academy of Sciences: U.S. Pat. No. 7,816,493
for example the M75 monoclonal antibody that is secreted from the hybridoma VU-M75, which was deposited at the American Type Culture Collection under ATCC No. HB 11128; or the V/10 monoclonal antibody secreted from the hybridoma V/10-VU, which was deposited at the International Depository Authority of the Belgian Coordinated Collection of Microorganisms (BCCM) at the Laboratorium voor Moleculaire Bioloqie-Plasmid-encollectie (LMBP) at the Universeit Gent in Gent, Belgium, under Accession No. LMBP 6009CB.
Institute of Virology, Slovak Academy of Sciences US20080177046; US20080176310; US20080176258; US20050031623
Novartis: US20090252738
Wilex: U.S. Pat. No. 7,691,375—for example the antibody produced by the hybridoma cell line DSM ASC 2526.
Wilex: US20110123537; Rencarex: Kennett R H., et al *Curr Opin Mol Ther.* 2003 Feb.; 5(1):70-5
Xencor: US20090162382
(45) EGFRv/II (Epidermal Growth Factor Receptor (EGFR), Transcript Variant 3,
Nucleotide
Genbank accession no. NM_201283
Genbank version no. NM_201283.1 GI:41327733
Genbank record update date: Sep. 30, 2012 01:47 PM Polypeptide
Genbank accession no. NP_958440
Genbank version no. NP_958440.1 GI:41327734
Genbank record update date: Sep. 30, 2012 01:47 PM
Cross-References
Batra S K., et al *Cell Growth Differ* 1995; 6:1251-1259.
Antibodies:
U.S. Pat. No. 7,628,986 and U.S. Pat. No. 7,736,644 (Amgen)
  For example, a heavy chain variable region amino acid sequence selected from the group consisting of SEQ ID NO: 142 and variants & a light chain variable region amino acid sequence selected from the group consisting of: SEQ ID NO: 144 and variants.
US20100111979 (Amgen)
  For example, an antibody comprising a heavy chain amino acid sequence comprising:
  CDR1 consisting of a sequence selected from the group consisting of the amino acid sequences for the CDR1 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17);
  CDR2 consisting of a sequence selected from the group consisting of the amino acid sequences for the CDR2 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17); and
  CDR3 consisting of a sequence selected from the group consisting of the amino acid sequences for the CDR3 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).
US20090240038 (Amgen)
  For example, an antibody having at least one of the heavy or light chain polypeptides comprises an amino acid sequence that is at least 90% identical to the amino acid sequence selected from the group consisting of: SEQ ID NO: 2, SEQ ID NO: 19, SEQ ID NO: 142, SEQ ID NO: 144, and any combination thereof.
US20090175887 (Amgen)
  For example, an antibody having a heavy chain amino acid sequence selected from the group consisting of the heavy chain amino acid sequence of antibody 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).
US20090156790 (Amgen)
  For example, antibody having heavy chain polypeptide and a light chain polypeptide, wherein at least one of the heavy or light chain polypeptides comprises an amino acid sequence that is at least 90% identical to the amino acid sequence selected from the group consisting of: SEQ ID NO: 2, SEQ ID NO: 19, SEQ ID NO: 142, SEQ ID NO: 144, and any combination thereof.
US20090155282, US20050059087 and US20050053608 (Amgen)
  For example, an antibody heavy chain amino acid sequence selected from the group consisting of the heavy chain amino acid sequence of antibody 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).
MR1-1 (U.S. Pat. No. 7,129,332; Duke)
  For example, a variant antibody having the sequence of SEQ ID NO. 18 with the substitutions S98P-T99Y in the CDR3 VH, and F92W in CDR3 VL.
L8A4, H10, Y10 (Wikstrand C J., et al *Cancer Res.* 1995 Jul. 15; 55(14):3140-8; Duke)
US20090311803 (Harvard University)
  For example, SEQ ID NO:9 for antibody heavy chain variable region, and SEQ ID NO: 3 for light chain variable region amino acid sequences US20070274991 (EMD72000, also known as matuzumab; Harvard University)
  For example, SEQ ID NOs: 3 & 9 for light chain and heavy chain respectively
U.S. Pat. No. 6,129,915 (Schering)
  For example, SEQ. ID NOs: 1, 2, 3, 4, 5 and 6.
mAb CH12—Wang H., et al *FASEB J.* 2012 Jan.; 26(1):73-80 (Shanghai Cancer Institute).
RAbDMvIII—Gupta P., et al *BMC Biotechnol.* 2010 Oct. 7; 10:72 (Stanford University Medical Center).
mAb Ua30—Ohman L., et al *Tumour Biol.* 2002 Mar.-Apr.; 23(2):61-9 (Uppsala University).
Han D G., et al *Nan Fang Yi Ke Da Xue Xue Bao.* 2010 Jan.; 30(1):25-9 (Xi'an Jiaotong University).
(46) CD33 (CD33 Molecule)
Nucleotide
Genbank accession no. M_23197
Genbank version no. NM_23197.1 GI:180097
Genbank record update date: Jun. 23, 2010 08:47 AM
Polypeptide
Genbank accession no. AAA51948
Genbank version no. AAA51948.1 GI:188098
Genbank record update date: Jun. 23, 2010 08:47 AM
Cross-References
Simmons D., et al *J. Immunol.* 141 (8), 2797-2800 (1988)
Other Information
Official Symbol: CD33
Other Aliases: SIGLEC-3, SIGLEC3, p67
Other Designations: CD33 antigen (gp67); gp67; myeloid cell surface antigen CD33; sialic acid binding Ig-like lectin 3; sialic acid-binding Ig-like lectin
Antibodies
H195 (Lintuzumab)—Raza A., et al *Leuk Lymphoma.* 2009 August; 50(8):1336-44; U.S. Pat. No. 6,759,045 (Seattle Genetics/Immunomedics)
mAb OKT9: Sutherland, D. R. et al. *Proc NatlAcad Sci USA* 78(7): 4515-4519 1981, Schneider, C., et al *J Biol Chem* 257, 8516-8522 (1982)
mAb E6: Hoogenboom, H. R., et al *J Immunol* 144, 3211-3217 (1990)
U.S. Pat. No. 6,590,088 (Human Genome Sciences)
  For example, SEQ ID NOs: 1 and 2 and ATCC accession no. 97521
U.S. Pat. No. 7,557,189 (Immunogen)
  For example, an antibody or fragment thereof comprising a heavy chain variable region which comprises three CDRs having the amino acid sequences of SEQ ID NOs:1-3 and a light chain variable region comprising three CDRs having the amino acid sequences of SEQ ID NOs:4-6.

(47) CD19 (CD19 Molecule)
Nucleotide
Genbank accession no. NM_001178098
Genbank version no. NM_001178098.1 GI:296010920
Genbank record update date: Sep. 10, 2012 12:43 AM
Polypeptide
Genbank accession no. NP_001171569
Genbank version no. NP_001171569.1 GI:296010921
Genbank record update date: Sep. 10, 2012 12:43 AM
Cross-References
Tedder T F., et al J. Immunol. 143 (2): 712-7 (1989)
Other Information
Official Symbol: CD19
Other Aliases: B4, CVID3
Other Designations: B-lymphocyte antigen CD19; B-lymphocyte surface antigen B4; T-cell surface antigen Leu-12; differentiation antigen CD19
Antibodies
Immunogen: HuB4—Al-Katib A M., et al Clin Cancer Res. 2009 Jun. 15; 15(12):4038-45.
4G7: Kügler M., et al Protein Eng Des Sel. 2009 Mar.; 22(3):135-47
  For example, sequences in FIG. 3 of Knappik, A. et al. J Mol Biol 2000 February; 296(1):57-86
AstraZeneca/MedImmune: MEDI-551—Herbst R., et al J Pharmacol Exp Ther. 2010 October; 335(1):213-22
Glenmark Pharmaceuticals: GBR-401—Hou S., et al Mol Cancer Ther November 2011 10 (Meeting Abstract Supplement) C164
U.S. Pat. No. 7,109,304 (Immunomedics)
  For example, an antibody comprising the sequence of hA19Vk (SEQ ID NO:7) and the sequence of hA19VH (SEQ ID NO:10)
U.S. Pat. No. 7,902,338 (Immunomedics)
  For example, an antibody or antigen-binding fragment thereof that comprises the light chain complementarity determining region CDR sequences CDR1 of SEQ ID NO: 16 (KASQSVDYDGDSYLN); CDR2 of SEQ ID NO: 17 (DASNLVS); and CDR3 of SEQ ID NO: 18 (QQSTEDPWT) and the heavy chain CDR sequences CDR1 of SEQ ID NO: 19 (SYWMN); CDR2 of SEQ ID NO: 20 (QIWPGDGDTNYNGKFKG) and CDR3 of SEQ ID NO: 21 (RETTTVGRYYYAMDY) and also comprises human antibody framework (FR) and constant region sequences with one or more framework region amino acid residues substituted from the corresponding framework region sequences of the parent murine antibody, and wherein said substituted FR residues comprise the substitution of serine for phenylalanine at Kabat residue 91 of the heavy chain variable region.
Medarex: MDX-1342—Cardarelli P M., et al Cancer Immunol Immunother. 2010 February; 59(2):257-65.
MorphoSys/Xencor: MOR-208/XmAb-5574—Zalevsky J., et al Blood. 2009 Apr. 16; 113(16):3735-43
U.S. Pat. No. 7,968,687 (Seattle Genetics)
  An antibody or antigen-binding fragment comprising a heavy chain variable domain comprising the amino acid sequence of SEQ ID NO:9 and a light chain variable domain comprising the amino acid sequence of SEQ ID NO: 24.
4G7 chim—Lang P., et al Blood. 2004 May 15; 103(10): 3982-5 (University of Tübingen)
  For example, FIG. 6 and SEQ ID No: 80 of US20120082664
Zhejiang University School of Medicine: 2E8—Zhang J., et al J Drug Target. 2010 Nov.; 18(9):675-8

(48) IL2RA (Interleukin 2 Receptor, Alpha); NCBI Reference Sequence: NM_000417.2);
Nucleotide
Genbank accession no. NM_000417
Genbank version no. NM_000417.2 GI:269973860
Genbank record update date: Sep. 9, 2012 04:59 PM
Polypeptide
Genbank accession no. NP_000408
Genbank version no. NP_000408.1 GI:4557667
Genbank record update date: Sep. 9, 2012 04:59 PM
Cross-References
Kuziel W. A., et al J. Invest. Dermatol. 94 (6 SUPPL), 27S-32S (1990)
Other Information
Official Symbol: IL2RA
Other Aliases: RP11-536K7.1, CD25, IDDM10, IL2R, TCGFR
Other Designations: FIL-2 receptor subunit alpha; IL-2-RA; IL-2R subunit alpha; IL2-RA; TAC antigen; interleukin-2 receptor subunit alpha; p55
Antibodies
U.S. Pat. No. 6,383,487 (Novartis/UCL: Baxilisimab [Simulect])
U.S. Pat. No. 6,521,230 (Novartis/UCL: Baxilisimab [Simulect])
  For example, an antibody having an antigen binding site comprises at least one domain which comprises CDR1 having the amino acid sequence in SEQ. ID. NO: 7, CDR2 having the amino acid sequence in SEQ. ID. NO: 8, and CDR3 having the amino acid sequence in SEQ. ID. NO: 9; or said CDR1, CDR2 and CDR3 taken in sequence as a whole comprise an amino acid sequence which is at least 90% identical to SEQ. ID. NOs: 7, 8 and 9 taken in sequence as a whole.
Daclizumab—Rech A J., et al Ann NY Acad Sci. 2009 September; 1174:99-106 (Roche)

(49) AXL (AXL Receptor Tyrosine Kinase)
Nucleotide
Genbank accession no. M76125
Genbank version no. M76125.1 GI:292869
Genbank record update date: Jun. 23, 2010 08:53 AM
Polypeptide
Genbank accession no. AAA61243
Genbank version no. AAA61243.1 GI:29870
Genbank record update date: Jun. 23, 2010 08:53 AM
Cross-References
O'Bryan J. P., et al Mol. Cell. Biol. 11 (10), 5016-5031 (1991); Bergsagel P. L., et al J. Immunol. 148 (2), 590-596 (1992)
Other Information
Official Symbol: AXL
Other Aliases: JTK11, UFO
Other Designations: AXL oncogene; AXL transforming sequence/gene; oncogene AXL; tyrosine-protein kinase receptor UFO
Antibodies
YW327.6S2—Ye X., et al Oncogene. 2010 Sep. 23; 29(38): 5254-64. (Genentech)
BergenBio: BGB324 (http://www.bergenbio.com/BGB324)

(50) CD30—TNFRSF8 (Tumor Necrosis Factor Receptor Superfamily, Member 8)
Nucleotide
Genbank accession no. M83554
Genbank version no. M83554.1 GI:180095
Genbank record update date: Jun. 23, 2010 08:53 AM Polypeptide
Genbank accession no. AAA51947
Genbank version no. AAA51947.1 GI:180096
Genbank record update date: Jun. 23, 2010 08:53 AM
Cross-References
Durkop H., et al *Cell* 68 (3), 421-427 (1992)
Other Information
Official Symbol: TNFRSF8
Other Aliases: CD30, D1S166E, Ki-1
Other Designations: CD30L receptor; Ki-1 antigen; cytokine receptor CD30; lymphocyte activation antigen CD30; tumor necrosis factor receptor superfamily member 8
(51) BCMA (B-Cell Maturation Antigen)—TNFRSF17 (Tumor Necrosis Factor Receptor Superfamily, Member 17)
Nucleotide
Genbank accession no. Z29574
Genbank version no. Z29574.1 GI:471244
Genbank record update date: Feb. 2, 2011 10:40 AM
Polypeptide
Genbank accession no. CAA82690
Genbank version no. CAA82690.1 GI:471245
Genbank record update date: Feb. 2, 2011 10:40 AM
Cross-References
Laabi Y., et al *Nucleic Acids Res.* 22 (7), 1147-1154 (1994)
Other Information
Official Symbol: TNFRSF17
Other Aliases: BCM, BCMA, CD269
Other Designations: B cell maturation antigen; B-cell maturation factor; B-cell maturation protein; tumor necrosis factor receptor superfamily member 17
(52) CT Ags—CTA (Cancer Testis Antigens)
Cross-References
Fratta E., et al. *Mol Oncol.* 2011 Apr.; 5(2):164-82; Lim S H., at al *Am J Blood Res.* 2012; 2(1):29-35.
(53) CD174 (Lewis Y)—FUT3 (Fucosyltransferase 3 (Galactoside 3(4)-L-Fucosyltransferase, Lewis Blood Group)
Nucleotide
Genbank accession no. NM000149
Genbank version no. NM000149.3 GI:148277008
Genbank record update date: Jun. 26, 2012 04:49 PM
Polypeptide
Genbank accession no. NP_000140
Genbank version no. NP_000140.1 GI:4503809
Genbank record update date: Jun. 26, 2012 04:49 PM
Cross-References
Kukowska-Latallo, J. F., et al *Genes Dev.* 4 (8), 1288-1303 (1990)
Other Information
Official Symbol: FUT3
Other Aliases: CD174, FT3B, FucT-III, LE, Les
Other Designations: Lewis F T; alpha-(1,3/1,4)-fucosyltransferase; blood group Lewis alpha-4-fucosyltransferase; fucosyltransferase III; galactoside 3(4)-L-fucosyltransferase
(54) CLEC14A (C-Type Lectin Domain Family 14, Member A; Genbank Accession No. NM175060)
Nucleotide
Genbank accession no. NM175060
Genbank version no. NM175060.2 GI:371123930
Genbank record update date: Apr. 1, 2012 03:34 PM
Polypeptide
Genbank accession no. NP_778230
Genbank version no. NP_778230.1 GI:28269707
Genbank record update date: Apr. 1, 2012 03:34 PM
Other Information
Official Symbol: CLEC14A
Other Aliases: UNQ236/PRO269, C14orf27, CEG1, EGFR-5
Other Designations: C-type lectin domain family 14 member A; CIECT and EGF-like domain containing protein; epidermal growth factor receptor 5
(55) GRP78—HSPA5 (Heat Shock 70 kDa Protein 5 (Glucose-Regulated Protein, 78 kDa)
Nucleotide
Genbank accession no. NM005347
Genbank version no. NM005347.4 GI:305855105
Genbank record update date: Sep. 30, 2012 01:42 PM
Polypeptide
Genbank accession no. NP_005338
Genbank version no. NP_005338.1 GI:16507237
Genbank record update date: Sep. 30, 2012 01:42 PM
Cross-References
Ting J., et al *DNA* 7 (4), 275-286 (1988) Other infromation
Official Symbol: HSPA5
Other Aliases: BIP, GRP78, MIF2
Other Designations: 78 kDa glucose-regulated protein; endoplasmic reticulum lumenal Ca(2+)-binding protein grp78; immunoglobulin heavy chain-binding protein
(56) CD70 (CD70 Molecule) L08096
Nucleotide
Genbank accession no. L08096
Genbank version no. L08096.1 GI:307127
Genbank record update date: Jun. 23, 2012 08:54 AM
Polypeptide
Genbank accession no. AAA36175
Genbank version no. AAA36175.1 GI:307128
Genbank record update date: Jun. 23, 2012 08:54 AM
Cross-References
Goodwin R. G., et al *Cell* 73 (3), 447-456 (1993)
Other Information
Official Symbol: CD70
Other Aliases: CD27L, CD27LG, TNFSF7
Other Designations: CD27 ligand; CD27-L; CD70 antigen; Ki-24 antigen; surface antigen CD70; tumor necrosis factor (ligand) superfamily, member 7; tumor necrosis factor ligand superfamily member 7
Antibodies
MDX-1411 against CD70 (Medarex)
h1F6 (Oflazoglu, E., et al, Clin Cancer Res. 2008 Oct. 1; 14(19):6171-80; Seattle Genetics)
For example, see US20060083736 SEQ ID NOs: 1, 2, 11 and 12 and FIG. 1.
(57) Stem Cell Specific Antigens. For Example:
5T4 (see entry (63) below)
CD25 (see entry (48) above)
CD32
  Polypeptide
    Genbank accession no. ABK42161
    Genbank version no. ABK42161.1 GI:117616286
    Genbank record update date: Jul. 25, 2007 03:00 PM
LGR5/GPR49
  Nucleotide
    Genbank accession no. NM_003667
    Genbank version no. NM_003667.2 GI:24475886
    Genbank record update date: Jul. 22, 2012 03:38 PM
  Polypeptide
    Genbank accession no. NP_003658
    Genbank version no. NP_003658.1 GI:4504379
    Genbank record update date: Jul. 22, 2012 03:38 PM
Prominin/CD133
  Nucleotide
    Genbank accession no. NM_006017
    Genbank version no. NM_006017.2 GI:224994187

Genbank record update date: Sep. 30, 2012 01:47 PM
Polypeptide
  Genbank accession no. NP_006008
  Genbank version no. NP_006008.1 GI:5174387
  Genbank record update date: Sep. 30, 2012 01:47 PM

(58) ASG-5
Cross-References
(Smith L. M., et. al *AACR* 2010 *Annual Meeting* (abstract #2590); Gudas J. M., et. al. *AACR* 2010 *Annual Meeting* (abstract #4393)
Antibodies
Anti-AGS-5 Antibody: M6.131 (Smith, L. M., et. al *AACR* 2010 *Annual Meeting* (abstract #2590)

(59) ENPP3 (Ectonucleotide Pyrophosphatase/Phosphodiesterase 3)
Nucleotide
Genbank accession no. AF005632
Genbank version no. AF005632.2 GI:4432589
Genbank record update date: Mar. 10, 2010 09:41 PM
Polypeptide
Genbank accession no. AAC51813
Genbank version no. AAC51813.1 GI:2465540
Genbank record update date: Mar. 10, 2010 09:41 PM
Cross-References
Jin-Hua P., et al *Genomics* 45 (2), 412-415 (1997)
Other Information
Official Symbol: ENPP3
Other Aliases: RP5-988G15.3, B10, CD203c, NPP3, PD-IBETA, PDNP3
Other Designations: E-NPP 3; dJ1005H11.3 (phosphodiesterase I/nucleotide pyrophosphatase 3); dJ914N13.3 (phosphodiesterase I/nucleotide pyrophosphatase 3); ectonucleotide pyrophosphatase/phosphodiesterase family member 3; gp130RB13-6; phosphodiesterase I beta; phosphodiesterase I/nucleotide pyrophosphatase 3; phosphodiesterase-I beta

(60) PRR4 (Proline Rich 4 (Lacrimal))
Nucleotide
Genbank accession no. NM_007244
Genbank version no. NM_007244.2 GI:154448885
Genbank record update date: Jun. 28, 2012 12:39 PM
Polypeptide
Genbank accession no. NP_009175
Genbank version no. NP_009175.2 GI:154448886
Genbank record update date: Jun. 28, 2012 12:39 PM
Cross-References
Dickinson D. P., et al *Invest. Ophthalmol. Vis. Sci.* 36 (10), 2020-2031 (1995)
Other Information
Official Symbol: PRR4
Other Aliases: LPRP, PROL4
Other Designations: lacrimal proline-rich protein; nasopharyngeal carcinoma-associated proline-rich protein 4; proline-rich polypeptide 4; proline-rich protein 4

(61) GCC—GUCY2C (Guanylate Cyclase 2C (Heat Stable Enterotoxin Receptor)
Nucleotide
Genbank accession no. NM_004963
Genbank version no. NM_004963.3 GI:222080082
Genbank record update date: Sep. 2, 2012 01:50 PM
Polypeptide
Genbank accession no. NP_004954
Genbank version no. NP_004954.2 GI:222080083
Genbank record update date: Sep. 2, 2012 01:50 PM
Cross-References
De Sauvage F. J., et al *J. Biol. Chem.* 266 (27), 17912-17918 (1991); Singh S., et al *Biochem. Biophys. Res. Commun.* 179 (3), 1455-1463 (1991)
Other Information
Official Symbol: GUCY2C
Other Aliases: DIAR6, GUC2C, MUCIL, STAR
Other Designations: GC-C; STA receptor; guanylyl cyclase C; hSTAR; heat-stable enterotoxin receptor; intestinal guanylate cyclase

(62) Liv-1—SLC39A6 (Solute Carrier Family 39 (Zinc Transporter), Member 6)
Nucleotide
Genbank accession no. U41060
Genbank version no. U41060.2 GI:12711792
Genbank record update date: Nov. 30, 2009 04:35 PM
Polypeptide
Genbank accession no. AAA96258
Genbank version no. AAA96258.2 GI:12711793
Genbank record update date: Nov. 30, 2009 04:35 PM
Cross-References
Taylor K M., et al *Biochim Biophys Acta.* 2003 Apr. 1; 1611(1-2):16-30
Other Information
Official Symbol: SLC39A6
Other Aliases: LIV-1
Other Designations: LIV-1 protein, estrogen regulated; ZIP-6; estrogen-regulated protein LIV-1; solute carrier family 39 (metal ion transporter), member 6; solute carrier family 39 member 6; zinc transporter ZIP6; zrt- and Irt-like protein 6

(63) 5T4, Trophoblast Glycoprotein, TPBG—TPBG (Trophoblast Glycoprotein)
Nucleotide
Genbank accession no. AJ012159
Genbank version no. AJ012159.1 GI:3805946
Genbank record update date: Feb. 1, 2011 10:27 AM
Polypeptide
Genbank accession no. CAA09930
Genbank version no. CAA09930.1 GI:3805947
Genbank record update date: Feb. 1, 2011 10:27 AM
Cross-References
King K. W., et al *Biochim. Biophys. Acta* 1445 (3), 257-270 (1999)
Other Information
  Official Symbol: TPBG
  Other Aliases: 5T4, 5T4AG, M6P1
  Other Designations: 5T4 oncofetal antigen; 5T4 oncofetal trophoblast glycoprotein; 5T4 oncotrophoblast glycoprotein

(64) CD56—NCMA1 (Neural Cell Adhesion Molecule 1)
Nucleotide
Genbank accession no. NM_000615
Genbank version no. NM_000615.6 GI:336285433
Genbank record update date: Sep. 23, 2012 02:32 PM
Polypeptide
Genbank accession no. NP_000606
Genbank version no. NP_000606.3 GI:94420689
Genbank record update date: Sep. 23, 2012 02:32 PM
Cross-References
Dickson, G., et al, *Cell* 50 (7), 1119-1130 (1987)
Other Information
Official Symbol: NCAM1
Other Aliases: CD56, MSK39, NCAM
Other Designations: antigen recognized by monoclonal antibody 5.1H11; neural cell adhesion molecule, NCAM Antibodies
Immunogen: HuN901 (Smith S V., et al *Curr Opin Mol Ther.* 2005 Aug.; 7(4):394-401)
    For example, see humanized from murine N901 antibody. See FIGS. 1b and 1e of Roguska, M. A., et al. Proc Natl Acad Sci USA February 1994; 91:969-973.
(65) CanAg (Tumor Associated Antigen CA242)
Cross-References
Haglund C., et al *Br J Cancer* 60:845-851, 1989; Baeckstrom D., et al *J Biol Chem* 266:21537-21547, 1991
Antibodies
huC242 (Tolcher A W et al., *J Clin Oncol.* 2003 Jan. 15; 21(2):211-22; Immunogen)
    For example, see US20080138898A1 SEQ ID NO: 1 and 2
(66) FOLR1 (Folate Receptor 1)
Nucleotide
Genbank accession no. J05013
Genbank version no. J05013.1 GI:182417
Genbank record update date: Jun. 23, 2010 08:47 AM
Polypeptide
Genbank accession no. AAA35823
Genbank version no. AAA35823.1 GI:182418
Genbank record update date: Jun. 23, 2010 08:47 AM
Cross-References
Elwood P. C., et al *J. Biol. Chem.* 264 (25), 14893-14901 (1989)
Other Information
Official Symbol: FOLR1
Other Aliases: FBP, FOLR
Other Designations: FR-alpha; KB cells FBP; adult folate-binding protein; folate binding protein; folate receptor alpha; folate receptor, adult; ovarian tumor-associated antigen MOv18
Antibodies
M9346A—Whiteman K R., et al *Cancer Res* Apr. 15, 2012; 72(8 Supplement): 4628 (Immunogen)
(67) GPNMB (Glycoprotein (Transmembrane) nmb)
Nucleotide
Genbank accession no. X76534
Genbank version no. X76534.1 GI:666042
Genbank record update date: Feb. 2, 2011 10:10 AM
Polypeptide
Genbank accession no. CAA54044
Genbank version no. CAA54044.1 GI:666043
Genbank record update date: Feb. 2, 2011 10:10 AM
Cross-References
Weterman M. A., et al *Int. J. Cancer* 60 (1), 73-81 (1995)
Other Information
Official Symbol: GPNMB
Other Aliases: UNQ1725/PRO9925, HGFIN, NMB
Other Designations: glycoprotein NMB; glycoprotein nmb-like protein; osteoactivin; transmembrane glycoprotein HGFIN; transmembrane glycoprotein NMB
Antibodies
Celldex Therapeutics: CR011 (Tse K F., et al *Clin Cancer Res.* 2006 Feb. 15; 12(4):1373-82)
    For example, see EP1827492B1 SEQ ID NO: 22, 24, 26, 31, 33 and 35
(68) TIM-1—HAVCR1 (Hepatitis A Virus Cellular Receptor 1)
Nucleotide
Genbank accession no. AF043724
Genbank version no. AF043724.1 GI:2827453
Genbank record update date: Mar. 10, 2010 06:24 PM
Polypeptide
Genbank accession no. AAC39862
Genbank version no. AAC39862.1 GI:2827454
Genbank record update date: Mar. 10, 2010 06:24 PM
Cross-References
Feigelstock D., et al *J. Virol.* 72 (8), 6621-6628 (1998)
Other Information
Official Symbol: HAVCR1
Other Aliases: HAVCR, HAVCR-1, KIM-1, KIM1, TIM, TIM-1, TIM1, TIMD-1, TIMD1
Other Designations: T cell immunoglobin domain and mucin domain protein 1; T-cell membrane protein 1; kidney injury molecule 1
(69) RG-1/Prostate Tumor Target Mindin—Mindin/RG-1
Cross-References
Parry R., et al Cancer Res. 2005 Sep. 15; 65(18):8397-405
(70) B7-H4—VTCN1 (V-Set Domain Containing T Cell Activation Inhibitor 1
Nucleotide
Genbank accession no. BX648021
Genbank version no. BX648021.1 GI:34367180
Genbank record update date: Feb. 2, 2011 08:40 AM
Cross-References
Sica G L., et al *Immunity.* 2003 Jun.; 18(6):849-61
Other Information
Official Symbol: VTCN1
Other Aliases: RP11-229A19.4, B7-H4, B7H4, B7S1, B7X, B7h.5, PRO1291, VCTN1
Other Designations: B7 family member, H4; B7 superfamily member 1; T cell costimulatory molecule B7x; T-cell costimulatory molecule B7x; V-set domain-containing T-cell activation inhibitor 1; immune costimulatory protein B7-H4
(71) PTK7 (PTK7 Protein Tyrosine Kinase 7)
Nucleotide
Genbank accession no. AF447176
Genbank version no. AF447176.1 GI:17432420
Genbank record update date: Nov. 28, 2008 01:51 PM
Polypeptide
Genbank accession no. AAL39062
Genbank version no. AAL39062.1 GI:17432421
Genbank record update date: Nov. 28, 2008 01:51 PM
Cross-References
Park S. K., et al *J. Biochem.* 119 (2), 235-239 (1996)
Other Information
Official Symbol: PTK7
Other Aliases: CCK-4, CCK4
Other Designations: colon carcinoma kinase 4; inactive tyrosine-protein kinase 7; pseudo tyrosine kinase receptor 7; tyrosine-protein kinase-like 7
(72) CD37 (CD37 Molecule)
Nucleotide
Genbank accession no. NM_001040031
Genbank version no. NM_001040031.1 GI:91807109
Genbank record update date: Jul. 29, 2012 02:08 PM
Polypeptide
Genbank accession no. NP_001035120
Genbank version no. NP_001035120.1 GI:91807110
Genbank record update date: Jul. 29, 2012 02:08 PM
Cross-References
Schwartz-Albiez R., et al *J. Immunol.* 140 (3), 905-914 (1988)
Other Information
Official Symbol: CD37
Other Aliases: GP52-40, TSPAN26

Other Designations: CD37 antigen; cell differentiation antigen 37; leukocyte antigen CD37; leukocyte surface antigen CD37; tetraspanin-26; tspan-26
Antibodies
Boehringer Ingelheim: mAb 37.1 (Heider K H., et al *Blood*. 2011 Oct. 13; 118(15):4159-68)
Trubion: CD37-SMIP (G28-1 scFv-Ig) ((Zhao X., et al *Blood*. 2007; 110: 2569-2577)
  For example, see US20110171208A1 SEQ ID NO: 253
Immunogen: K7153A (Deckert J., et al *Cancer Res* Apr. 15, 2012; 72(8 Supplement): 4625)
(73) CD138—SDC1 (Syndecan 1)
Nucleotide
Genbank accession no. AJ551176
Genbank version no. AJ551176.1 GI:29243141
Genbank record update date: Feb. 1, 2011 12:09 PM
Polypeptide
Genbank accession no. CAD80245
Genbank version no. CAD80245.1 GI:29243142
Genbank record update date: Feb. 1, 2011 12:09 PM
Cross-References
O'Connell F P., et al *Am J Clin Pathol*. 2004 February; 121(2):254-63
Other Information
Official Symbol: SDC1
Other Aliases: CD138, SDC, SYND1, syndecan
Other Designations: CD138 antigen; heparan sulfate proteoglycan fibroblast growth factor receptor; syndecan proteoglycan 1; syndecan-1
Antibodies
Biotest: chimerized MAb (nBT062)—(Jagannath S., et al Poster ASH #3060, 2010; WIPO Patent Application WO/2010/128087)
  For example, see US20090232810 SEQ ID NO: 1 and 2
  Immunogen: B-B4 (Tassone P., et al *Blood* 104_3688-3696)
  For example, see US20090175863A1 SEQ ID NO: 1 and 2
(74) CD74 (CD74 Molecule, Major Histocompatibility Complex, Class II Invariant Chain)
Nucleotide
Genbank accession no. NM_004355
Genbank version no. NM_004355.1 GI:343403784
Genbank record update date: Sep. 23, 2012 02:30 PM
Polypeptide
Genbank accession no. NP_004346
Genbank version no. NP_004346.1 GI:10835071
Genbank record update date: Sep. 23, 2012 02:30 PM
Cross-References
Kudo, J., et al *Nucleic Acids Res*. 13 (24), 8827-8841 (1985)
Other Information
Official Symbol: CD74
Other Aliases: DHLAG, HLADG, II, Ia-GAMMA
Other Designations: CD74 antigen (invariant polypeptide of major histocompatibility complex, class II antigen-associated); HLA class II histocompatibility antigen gamma chain; HLA-DR antigens-associated invariant chain; HLA-DR-gamma; Ia-associated invariant chain; MHC HLA-DR gamma chain; gamma chain of class II antigens; p33
Antibodies
Immunomedics: hLL1 (Milatuzumab,)—Berkova Z., et al *Expert Opin Investig Drugs*. 2010 Jan.; 19(1):141-9)
  For example, see US20040115193 SEQ ID NOs: 19, 20, 21, 22, 23 and 24
Genmab: HuMax-CD74 (see website)

(75) Claudins—CLs (Claudins)
Cross-References
Offner S., et al *Cancer Immunol Immunother*. 2005 May; 54(5):431-45, Suzuki H., et al *Ann NY Acad Sci*. 2012 July; 1258:65-70)
In humans, 24 members of the family have been described—see literature reference.
(76) EGFR (Epidermal Growth Factor Receptor)
Nucleotide
Genbank accession no. NM_005228
Genbank version no. NM_005228.3 GI:41927737
Genbank record update date: Sep. 30, 2012 01:47 PM
Polypeptide
Genbank accession no. NP_005219
Genbank version no. NP_005219.2 GI:29725609
Genbank record update date: Sep. 30, 2012 01:47 PM
Cross-References
Dhomen N S., et al *Crit Rev Oncog*. 2012; 17(1):31-50
Other Information
Official Symbol: EGFR
Other Aliases: ERBB, ERBB1, HER1, PIG61, mENA
Other Designations: avian erythroblastic leukemia viral (v-erb-b) oncogene homolog; cell growth inhibiting protein 40; cell proliferation-inducing protein 61; proto-oncogene c-ErbB-1; receptor tyrosine-protein kinase erbB-1
Antibodies
BMS: Cetuximab (Erbitux)—Broadbridge V T., et al *Expert Rev Anticancer Ther*. 2012 May; 12(5):555-65.
  For example, see U.S. Pat. No. 6,217,866—ATTC deposit No. 9764.
Amgen: Panitumumab (Vectibix)—Argiles G., et al *Future Oncol*. 2012 Apr.; 8(4):373-89
  For example, see U.S. Pat. No. 6,235,883 SEQ ID NOs: 23-38.
Genmab: Zalutumumab—Rivera F., et al *Expert Opin Biol Ther*. 2009 May; 9(5):667-74.
YM Biosciences: Nimotuzumab—Ramakrishnan M S., et al *MAbs*. 2009 Jan.-Feb.; 1(1):41-8.
  For example, see U.S. Pat. No. 5,891,996 SEQ ID NOs: 27-34.
(77) Her3 (ErbB3)—ERBB3 (v-Erb-b2 Erythroblastic Leukemia Viral Oncogene Homolog 3 (Avian))
Nucleotide
Genbank accession no. M34309
Genbank version no. M34309.1 GI:183990
Genbank record update date: Jun. 23, 2010 08:47 PM
Polypeptide
Genbank accession no. AAA35979
Genbank version no. AAA35979.1 GI:306841
Genbank record update date: Jun. 23, 2010 08:47 PM
Cross-References
Plowman, G. D., et al., *Proc. Natl. Acad. Sci. U.S.A.* 87 (13), 4905-4909 (1990)
Other Information
Official Symbol: ERBB3
Other Aliases: ErbB-3, HER3, LCCS2, MDA-BF-1, c-erbB-3, c-erbB3, erbB3-S, p180-ErbB3, p45-sErbB3, p85-sErbB3
Other Designations: proto-oncogene-like protein c-ErbB-3; receptor tyrosine-protein kinase erbB-3; tyrosine kinase-type cell surface receptor HER3
Antibodies
Merimack Pharma: MM-121 (Schoeberl B., et al *Cancer Res*. 2010 Mar. 15; 70(6):2485-2494)
  For example, see US2011028129 SEQ ID NOs: 1, 2, 3, 4, 5, 6, 7 and 8.

(78) RON—MST1R (Macrophage Stimulating 1 Receptor (c-Met-Related Tyrosine Kinase))
Nucleotide
Genbank accession no. X70040
Genbank version no. X70040.1 GI:36109
Genbank record update date: Feb. 2, 2011 10:17 PM
Polypeptide
Genbank accession no. CCA49634
Genbank version no. CCA49634.1 GI:36110
Genbank record update date: Feb. 2, 2011 10:17 PM
Cross-References
Ronsin C., et al Oncogene 8 (5), 1195-1202 (1993)
Other Information
Official Symbol: MST1R
Other Aliases: CD136, CDw136, PTK8, RON
Other Designations: MSP receptor; MST1R variant RON30; MST1R variant RON62; PTK8 protein tyrosine kinase 8; RON variant E2E3; c-met-related tyrosine kinase; macrophage-stimulating protein receptor; p185-Ron; soluble RON variant 1; soluble RON variant 2; soluble RON variant 3; soluble RONvariant 4

(79) EPHA2 (EPH Receptor A2)
Nucleotide
Genbank accession no. BC037166
Genbank version no. BC037166.2 GI:33879863
Genbank record update date: Mar. 6, 2012 01:59 PM
Polypeptide
Genbank accession no. AAH37166
Genbank version no. AAH37166.1 GI:22713539
Genbank record update date: Mar. 6, 2012 01:59 PM
Cross-References
Strausberg R. L., et al Proc. Natl. Acad. Sci. U.S.A. 99 (26), 16899-16903 (2002)
Other Information
Official Symbol: EPHA2
Other Aliases: ARCC2, CTPA, CTPP1, ECK
Other Designations: ephrin type-A receptor 2; epithelial cell receptor protein tyrosine kinase; soluble EPHA2 variant 1; tyrosine-protein kinase receptor ECK
Antibodies
Medimmune: 1C1 (Lee J W., et al Clin Cancer Res. 2010 May 1; 16(9):2562-2570)
For example, see US20090304721A1 FIGS. 7 and 8.

(80) CD20—MS4A1 (Membrane-Spanning 4-Domains, Subfamily A, Member 1)
Nucleotide
Genbank accession no. M27394
Genbank version no. M27394.1 GI:179307
Genbank record update date: Nov. 30, 2009 11:16 AM
Polypeptide
Genbank accession no. AAA35581
Genbank version no. AAA35581.1 GI:179308
Genbank record update date: Nov. 30, 2009 11:16 AM
Cross-References
Tedder T. F., et al Proc. Natl. Acad. Sci. U.S.A. 85 (1), 208-212 (1988)
Other Information
Official Symbol: MS4A1
Other Aliases: B1, Bp35, CD20, CVID5, LEU-16, MS4A2, S7
Other Designations: B-lymphocyte antigen CD20; B-lymphocyte cell-surface antigen B1; CD20 antigen; CD20 receptor; leukocyte surface antigen Leu-16
Antibodies
Genentech/Roche: Rituximab—Abdulla N E., et al BioDrugs. 2012 Apr. 1; 26(2):71-82.
For example, see U.S. Pat. No. 5,736,137, ATCC deposit No. HB-69119.
GSK/Genmab: Ofatumumab—Nightingale G., et al Ann Pharmacother. 2011 October; 45(10):1248-55.
For example, see US20090169550A1 SEQ ID NOs: 2, 4 and 5.
Immunomedics: Veltuzumab—Goldenberg D M., et al Leuk Lymphoma. 2010 May; 51(5):747-55.
For example, see U.S. Pat. No. 7,919,273B2 SEQ ID NOs: 1, 2, 3, 4, 5 and 6.

(81) Tenascin C—TNC (Tenascin C)
Nucleotide
Genbank accession no. NM_002160
Genbank version no. NM_002160.3 GI:340745336
Genbank record update date: Sep. 23, 2012 02:33 PM
Polypeptide
Genbank accession no. NP_002151
Genbank version no. NP_002151.2 GI:153946395
Genbank record update date: Sep. 23, 2012 02:33 PM
Cross-References
Nies D. E., et al J. Biol. Chem. 266 (5), 2818-2823 (1991); Siri A., et al Nucleic Acids Res. 19 (3), 525-531 (1991)
Other Information
Official Symbol: TNC
Other Aliases: 150-225, GMEM, GP, HXB, JI, TN, TN-C
Other Designations: GP 150-225; cytotactin; glioma-associated-extracellular matrix antigen; hexabrachion (tenascin); myotendinous antigen; neuronectin; tenascin; tenascin-C isoform 14/AD1/16
Antibodies
Philogen: G11 (von Lukowicz T., et al J Nucl Med. 2007 April; 48(4):582-7) and F16 (Pedretti M., et al Lung Cancer. 2009 April; 64(1):28-33)
For example, see U.S. Pat. No. 7,968,685 SEQ ID NOs: 29, 35, 45 and 47.

(82) FAP (Fibroblast Activation Protein, Alpha)
Nucleotide
Genbank accession no. U09278
Genbank version no. U09278.1 GI:1888315
Genbank record update date: Jun. 23, 2010 09:22 AM
Polypeptide
Genbank accession no. AAB49652
Genbank version no. AAB49652.1 GI:1888316
Genbank record update date: Jun. 23, 2010 09:22 AM
Cross-References
Scanlan, M. J., et al Proc. Natl. Acad. Sci. U.S.A. 91 (12), 5657-5661 (1994)
Other Information
Official Symbol: FAP
Other Aliases: DPPIV, FAPA
Other Designations: 170 kDa melanoma membrane-bound gelatinase; integral membrane serine protease; seprase

(83) DKK-1 (Dickkopf 1 Homolog (Xenopus laevis))
Nucleotide
Genbank accession no. NM_012242
Genbank version no. NM_012242.2 GI:61676924
Genbank record update date: Sep. 30, 2012 01:48 PM
Polypeptide
Genbank accession no. NP_036374
Genbank version no. NP_036374.1 GI:7110719
Genbank record update date: Sep. 30, 2012 01:48 PM
Cross-References
Fedi P. et al J. Biol. Chem. 274 (27), 19465-19472 (1999)
Other Information
Official Symbol: DKK1
Other Aliases: UNQ492/PRO1008, DKK-1, SK Other Designations: dickkopf related protein-i; dickkopf-1 like; dickkopf-like protein 1; dickkopf-related protein 1; hDkk-1

Antibodies

Novartis: BHQ880 (Fulciniti M., et al *Blood.* 2009 Jul. 9; 114(2):371-379)

For example, see US20120052070A1 SEQ ID NOs: 100 and 108. (84) CD52 (CD52 molecule)

Nucleotide

Genbank accession no. NM_001803

Genbank version no. NM_001803.2 GI:68342029

Genbank record update date: Sep. 30, 2012 01:48 PM

Polypeptide

Genbank accession no. NP_001794

Genbank version no. NP_001794.2 GI:68342030

Genbank record update date: Sep. 30, 2012 01:48 PM

Cross-References

Xia M. Q., et al *Eur. J. Immunol.* 21 (7), 1677-1684 (1991)

Other Information

Official Symbol: CD52

Other Aliases: CDW52

Other Designations: CAMPATH-1 antigen; CD52 antigen (CAMPATH-1 antigen); CDW52 antigen (CAMPATH-1 antigen); cambridge pathology 1 antigen; epididymal secretory protein E5; he5; human epididymis-specific protein 5

Antibodies

Alemtuzumab (Campath)—Skoetz N., et al *Cochrane Database Syst Rev.* 2012 Feb. 15; 2:CD008078.

For example, see Drugbank Acc. No. DB00087 (BIOD00109, BTD00109)

(85) CS1—SLAMF7 (SLAM Family Member 7)

Nucleotide

Genbank accession no. NM_021181

Genbank version no. NM_021181.3 GI:1993571

Genbank record update date: Jun. 29, 2012 11:24 AM

Polypeptide

Genbank accession no. NP_067004

Genbank version no. NP_067004.3 GI:19923572

Genbank record update date: Jun. 29, 2012 11:24 AM

Cross-References

Boles K. S., et al *Immunogenetics* 52 (3-4), 302-307 (2001)

Other Information

Official Symbol: SLAMF7

Other Aliases: UNQ576/PRO1138, 19A, CD319, CRACC, CS1

Other Designations: 19A24 protein; CD2 subset 1; CD2-like receptor activating cytotoxic cells; CD2-like receptor-activating cytotoxic cells; membrane protein FOAP-12; novel LY9 (lymphocyte antigen 9) like protein; protein 19A Antibodies BMS: elotuzumab/HuLuc63 (Benson D M., et al *J Clin Oncol.* 2012 Jun. 1; 30(16):2013-2015)

For example, see US20110206701 SEQ ID NOs: 9, 10, 11, 12, 13, 14, 15 and 16.

(86) Endoglin—ENG (Endoglin)

Nucleotide

Genbank accession no. AF035753

Genbank version no. AF035753.1 GI:3452260

Genbank record update date: Mar. 10, 2010 06:36 PM

Polypeptide

Genbank accession no. AAC32802

Genbank version no. AAC32802.1 GI:3452261

Genbank record update date: Mar. 10, 2010 06:36 PM

Cross-References

Rius C., et al *Blood* 92 (12), 4677-4690 (1998)

Official Symbol: ENG

Other Information

Other Aliases: RP11-228B15.2, CD105, END, HHT1, ORW, ORW1

Other Designations: CD105 antigen

(87) Annexin A1—ANXA1 (Annexin A1)

Nucleotide

Genbank accession no. X05908

Genbank version no. X05908.1 GI:34387

Genbank record update date: Feb. 2, 2011 10:02 AM

Polypeptide

Genbank accession no. CCA29338

Genbank version no. CCA29338.1 GI:34388

Genbank record update date: Feb. 2, 2011 10:02 AM

Cross-References

Wallner B. P., et al *Nature* 320 (6057), 77-81 (1986)

Other Information

Official Symbol: ANXA1

Other Aliases: RP11-71A24.1, ANX1, LPC1

Other Designations: annexin I (lipocortin I); annexin-1; calpactin II; calpactin-2; chromobindin-9; lipocortin I; p35; phospholipase A2 inhibitory protein

(88) V-CAM (CD106)—VCAM1 (Vascular Cell Adhesion Molecule 1)

Nucleotide

Genbank accession no. M60335

Genbank version no. M60335.1 GI:340193

Genbank record update date: Jun. 23, 2010 08:56 AM

Polypeptide

Genbank accession no. AAA61269

Genbank version no. AAA61269.1 GI:340194

Genbank record update date: Jun. 23, 2010 08:56 AM

Cross-References

Hession C., et al *J. Biol. Chem.* 266 (11), 6682-6685 (1991)

Other Information

Official Symbol VCAM1

Other Aliases: CD106, INCAM-100

Other Designations: CD106 antigen; vascular cell adhesion protein 1

| Antibody Sequences |
|---|
| Anti-Integrin avβ6 |

RHAB6.2
QVQLVQSGSELKKPGASVKISCKASGFAFTDSYMHWVRQAPGQGLEWMGWIDPENGDTE
YAPKFQGRFVFSLDTSVSTAYLQISSLKAEDTAVYYCTRGTPTAVPNLRGDLQVLAQKVAG
PYPFDYWGQGTLVTVSS
RHCB6.2
QVQLVQSGAEVKKPGASVKVSCKASGYTFIDSYMHWVRQAPGQRLEWMGWIDPENGDTE
YAPKFQGRVTITTDTSASTAYMELSSLRSEDTAVYYCARGTPTAVPNLRGDLQVLAQKVAG
PYPFDYWGQGTLVTVSS
RHF

Antibody Sequences

QVQLVQSGAEVKKPGASVKVSCKASGFNFIDSYMHWVRQAPGQRLEWMGWIDPENGDT
EYAPKFQGRVTFTTDTSASTAYMELSSLRSEDTAVYYCNEGTPTGPYYFDYWGQGTLVTV
SS
RHFB6
QVQLVQSGAEVKKPGASVKVSCKASGFNFIDSYMHWVRQAPGQRLEWMGWIDPENGDT
EYAPKFQGRVTFTTDTSASTAYMELSSLRSEDTAVYYCNEGTPTAVPNLRGDLQVLAQKVA
GPYYFDYWGQGTLVTVSS
RHAY100bP
QVQLVQSGSELKKPGASVKISCKASGFAFTDSYMHWVRQAPGQGLEWMGWIDPENGDTE
YAPKFQGRFVFSLDTSVSTAYLQISSLKAEDTAVYYCTRGTPTGPYPFDYWGQGTLVTVSS
RKF
ENVLTQSPGTLSLSPGERATLSCSASSSVSYMHWFQQKPGQAPRLLIYSTSNLASGIPDRF
SGSGSGTDFTLTISRLEPEDFAVYYCQQRSSYPLTFGGGTKVEIK
RKFL36L50
ENVLTQSPGTLSLSPGERATLSCSASSSVSYMHWLQQKPGQAPRLLIYLTSNLASGIPDRF
SGSGSGTDFTLTISRLEPEDFAVYYCQQRSSYPLTFGGGTKVEIK
RKC
EIVLTQSPGTLSLSPGERATLSCSASSSVSYMHWFQQKPGQAPRLLIYSTSNLASGIPDRFS
GSGSGTDFTLTISRLEPEDFAVYYCQQRSSYPLTFGGGTKVEIK

Anti-CD33

CD33 Hum195 VH
QVQLVQSGAEVKKPGSSVKVSCKASGYTFTDYNMHWVRQAPGQGLEWIGYIYPYNGGTG
YNQKFKSKATITADESTNTAYMELSSLRSEDTAVYYCARGRPAMDYWGQGTLVTVSS
CD33 Hum195 VK
DIQMTQSPSSLSASVGDRVTITCRASESVDNYGISFMNWFQQKPGKAPKLLIYAASNQGSG
VPSRFSGSGSGTDFTLTISSLQPDDFATYYCQQSKEVPWTFGQGTKVEIK

Anti-CD19

CD19 B4 resurfaced VH
QVQLVQPGAEVVKPGASVKLSCKTSGYTFTSNWMHWVKQRPGQGLEWIGEIDPSDSYTN
YNQNFKGKAKLTVDKSTSTAYMEVSSLRSDDTAVYYCARGSNPYYYAMDYWGQGTSVTV
SS
CD19 B4 resurfaced VK
EIVLTQSPAIMSASPGERVTMTCSASSGVNYMHWYQQKPGTSPRRWIYDTSKLASGVPAR
FSGSGSGTSYSLTISSMEPEDAATYYCHQRGSYTFGGGTKLEIK

Anti-Her2

Herceptin VH chain
EVQLVESGGGLVQPGGSLRLSCAASGFNIKDTYIHWVRQAPGKGLEWVARIYPTNGYTRY
ADSVKGRFTISADTSKNTAYLQMNSLRAEDTAVYYCSRWGGDGFYAMDYWGQGTLVTVS
S
Herceptin VL chain
DIQMTQSPSSLSASVGDRVTITCRASQDVNTAVAWYQQKPGKAPKLLIYSASFLYSGVPSR
FSGSRSGTDFTLTISSLQPEDFATYYCQQHYTTPPTFGQGTKVEIK

Anti-CD25

Simulect VK (also known as Basiliximab)
QIVSTQSPAIMSASPGEKVTMTCSASSSRSYMQWYQQKPGTSPKRWIYDTSKLASGVPAR
FSGSGSGTSYSLTISSMEAEDAATYYCHQRSSYTFGGGTKLEIK
Simulect VH
QLQQSGTVLARPGASVKMSCKASGYSFTRYWMHWIKQRPGQGLEWIGAIYPGNSDTSYN
QKFEGKAKLTAVTSASTAYMELSSLTHEDSAVYYCSRDYGYYFDFWGQGTTLTVSS

Anti-PSMA

Deimmunised VH '1
EVQLVQSGPEVKKPGATVKISCKTSGYTFTEYTIHWVKQAPGKGLEWIGNINPNNGGTTYN
QKFEDKATLTVDKSTDTAYMELSSLRSEDTAVYYCAAGWNFDYWGQGTLLTVSS
Deimmunised VK '1
DIQMTQSPSSLSTSVGDRVTLTCKASQDVGTAVDWYQQKPGSPKLLIYWASTRHTGIPSR
FSGSGSGTDFTLTISSLQPEDFADYYCQQYNSYPLTFGPGTKVDIK
Deimmunised VH1 '5
EVKLVESGGGLVQPGGSMKLSCVASGFTFSNYWMNWVRQAPGKGLEWVAEIRSQSNNF
ATHYAESVKGRVTISRDDSKSIVYLQMNNLRAEDTGVYYCTRRWNNFWGQGTTVTVSS
Deimmunised VH2 '5
EVKLVESGGGLVQPGGSLKLSCVASGFTFSNYWMNWVRQAPGKGLEWVAEIRSQSNNFA
THYAESVKGRVTISRDDSKSIVYLQMNNLRAEDTAVYYCTRRWNNFWGQGTTVTVSS
Deimmunised VH3 '5
EVLVESGGGLVQPGGSLKLSCVASGFTFSNYWMNWVRQAPGKGLEWVAEIRSQSNNFA
THYAESVKGRVTISRDDSKSIVYLQMNNLRAEDTAVYYCTRRWNNFWGQGTTVTVSS

Antibody Sequences

```
Deimmunised VH4 '5
EVQLVESGGGLVQPGGSLKLSCVASGFTFSNYWMNWVRQAPGKGLEWVAEIRSQSNNFA
THYAESVKGRFTISRDDSKSIVYLQMNNLRAEDTAVYYCTRRWNNFWGQGTTVTVSS
Deimmunised VK1 '5
NIVMTQFPSSMSASVGDRVTITCKASENVGTYVSWYQQKPDQSPKMLIYGASNRFTGVPD
RFTGSGSATDFTLTISSLQTEDLADYYCGQSYTFPYTFGQGTKLEMK
Deimmunised VK2 '5
NIVMTQFPSSMSASVGDRVTITCKASENVGTYVSWYQQKPDQSPKMLIYGASNRFTGVPD
RFSGSGSGTDFTLTISSLQAEDLADYYCGQSYTFPYTFGQGTKLEIK
Deimmunised VK3 '5
NIQMTQFPSAMSASVGDRVTITCKASENVGTYVSWYQQKPDQSPKMLIYGASNRFTGVPD
RFSGSGSGTDFTLTISSLQAEDLADYYCGQSYTFPYTFGQGTKLEIK
Deimmunised VK4 '5
NIQMTQFPSAMSASVGDRVTITCKASENVGTYVSWYQQKPDQSPKMLIYGASNRFTGVPD
RFSGSGSGTDFTLTISSLQAEDEADYYCGQSYTFPYTFGQGTKLEIK
Deimmunised VK DI '5
NIVMTQFPKSMSASAGERMTLTCKASENVGTYVSWYQQKPTQSPKMLIYGASNRFTGVPD
RFSGSGSGTDFILTISSVQAEDLVDYYCGQSYTFPYTFGGGTKLEMK
Deimmunised VH DI '5
EVKLEESGGGLVQPGGSMKISCVASGFTFSNYWMNWVRQSPEKGLEWVAEIRSQSNNFA
THYAESVKGRVIISRDDSKSSVYLQMNSLRAEDTAVYYCTRRWNNFWGQGTTVTVSS
Humanised RHA '5
EVQLVESGGGLVQPGGSLKLSCAASGFTFSNYWMNWVRQASGKGLEWVGEIRSQSNNFA
THYAESVKGRFTISRDDSKNTAYLQMNSLKTEDTAVYYCTRRWNNFWGQGTTVTVSS
Humanised RHB '5
EVKLVESGGGLVQPGGSLKLSCAASGFTFSNYWMNWVRQASGKGLEWVAEIRSQSNNFA
THYAESVKGRVIISRDDSKNTVYLQMNSLRTEDTAVYYCTRRWNNFWGQGTTVTVSS
Humanised RHC '5
EVQLVESGGGLVQPGGSLKLSCAASGFTFSNYWMNWVRQASGKGLEWVAEIRSQSNNFA
THYAESVKGRVIISRDDSKNTVYLQMNSLRTEDTAVYYCTRRWNNFWGQGTTVTVSS
Humanised RHD '5
EVKLVESGGGLVQPGGSLKLSCAASGFTFSNYWMNWVRQASGKGLEWVGEIRSQSNNFA
THYAESVKGRVIISRDDSKNTVYLQMNSLRTEDTAVYYCTRRWNNFWGQGTTVTVSS
Humanised RHE '5
EVKLVESGGGLVQPGGSLKLSCAASGFTFSNYWMNWVRQASGKGLEWVAEIRSQSNNFA
THYAESVKGRFTISRDDSKNTVYLQMNSLRTEDTAVYYCTRRWNNFWGQGTTVTVSS
Humanised RHF '5
EVKLVESGGGLVQPGGSLKLSCAASGFTFSNYWMNWVRQASGKGLEWVAEIRSQSNNFA
THYAESVKGRVIISRDDSKNTAYLQMNSLRTEDTAVYYCTRRWNNFWGQGTTVTVSS
Humanised RHG '5
EVKLVESGGGLVQPGGSLKLSCAASGFTFSNYWMNWVRQASGKGLEWVAEIRSQSNNFA
THYAESVKGRVIISRDDSKNTAYLQMNSLRTEDTAVYYCTRRWNNFWGQGTTVTVSS
Humanised RKA '5
DIQMTQSPSSVSASVGDRVTITCKASENVGTYVSWYQQKPGTAPKLLIYGASNRFTGVPSR
FSGSGSATDFTLTINNLQPEDFATYYCGQSYTFPYTFGQGTKVEIK
Humanised RKB '5
DIQMTQSPSSVSASVGDRVTITCKASENVGTYVSWYQQKPGTAPKLLIYGASNRFTGVPSR
FSGSGSATDFTLTINNLQPEDFATYYCGQSYTFPYTFGQGTKVEIK
Humanised RKC '5
DIQMTQSPSSVSASVGDRVTITCKASENVGTYVSWYQQKPGTAPKMLIYGASNRFTGVPS
RFSGSGSATDFTLTINNLQPEDFATYYCGQSYTFPYTFGQGTKVEIK
Humanised RKD '5
DIQMTQSPSSVSASVGDRVTITCKASENVGTYVSWYQQKPGTAPKMLIYGASNRFTGVPS
RFSGSGSATDFTLTINNLQPEDFATYYCGQSYTFPYTFGQGTKVEIK
Humanised RKE '5
NIVMTQSPSSVSASVGDRVTITCKASENVGTYVSWYQQKPGTAPKLLIYGASNRFTGVPDR
FTGSGSATDFILTINNLQPEDFATYYCGQSYTFPYTFGQGTKVEIK
Humanised RKF '5
NIVMTQSPSSVSASVGDRVTITCKASENVGTYVSWYQQKPGTAPKMLIYGASNRFTGVPSR
FSGSGSATDFILTINNLQPEDFATYYCGQSYTFPYTFGQGTKVEIK
Humanised RKG '5
NIVMTQSPSSVSASVGDRVTITCKASENVGTYVSWYQQKPGTAPKMLIYGASNRFTGVPDR
FTGSGSATDFTLTINNLQPEDFATYYCGQSYTFPYTFGQGTKVEIK
```

The parent antibody may also be a fusion protein comprising an albumin-binding peptide (ABP) sequence (Dennis et al. (2002) "Albumin Binding As A General Strategy For Improving The Pharmacokinetics Of Proteins" *J Biol Chem.* 277:35035-35043; WO 01/45746). Antibodies of the invention include fusion proteins with ABP sequences taught by: (i) Dennis et al (2002) *J Biol Chem.* 277:35035-35043 at Tables III and IV, page 35038; (ii) US 2004/0001827 at [0076]; and (iii) WO 01/45746 at pages 12-13, and all of which are incorporated herein by reference.

In one embodiment, the antibody has been raised to target specific the tumour related antigen $\alpha_v\beta_6$.

The cell binding agent may be labelled, for example to aid detection or purification of the agent either prior to incorporation as a conjugate, or as part of the conjugate. The label may be a biotin label. In another embodiment, the cell binding agent may be labelled with a radioisotope.

Embodiments of the present invention include ConjA wherein the cell binding agent is selected from an antibody to any of the antigens discussed above.

Embodiments of the present invention include ConjB wherein the cell binding agent is selected from an antibody to any of the antigens discussed above.

Embodiments of the present invention include ConjA wherein the cell binding agent is selected from any of the antibodies discussed above.

Embodiments of the present invention include ConjB wherein the cell binding agent is selected from any of the antibodies discussed above.

The present invention may also relate to conjugates where the cell binding agent is selected from an antibody to any of the antigens discussed above and any of the antibodies discussed above linked to different drugs.

Drug Loading

The drug loading is the average number of PBD drugs per cell binding agent, e.g. antibody. Where the compounds of the invention are bound to cysteines, drug loading may range from 1 to 8 drugs (D) per cell binding agent, i.e. where 1, 2, 3, 4, 5, 6, 7, and 8 drug moieties are covalently attached to the cell binding agent. Compositions of conjugates include collections of cell binding agents, e.g. antibodies, conjugated with a range of drugs, from 1 to 8. Where the compounds of the invention are bound to lysines, drug loading may range from 1 to 80 drugs (D) per cell binding agent, although an upper limit of 40, 20, 10 or 8 may be preferred. Compositions of conjugates include collections of cell binding agents, e.g. antibodies, conjugated with a range of drugs, from 1 to 80, 1 to 40, 1 to 20, 1 to 10 or 1 to 8.

The average number of drugs per antibody in preparations of ADC from conjugation reactions may be characterized by conventional means such as UV, reverse phase HPLC, HIC, mass spectroscopy, ELISA assay, and electrophoresis. The quantitative distribution of ADC in terms of p may also be determined. By ELISA, the averaged value of p in a particular preparation of ADC may be determined (Hamblett et al (2004) Clin. Cancer Res. 10:7063-7070; Sanderson et al (2005) Clin. Cancer Res. 11:843-852). However, the distribution of p (drug) values is not discernible by the antibody-antigen binding and detection limitation of ELISA. Also, ELISA assay for detection of antibody-drug conjugates does not determine where the drug moieties are attached to the antibody, such as the heavy chain or light chain fragments, or the particular amino acid residues. In some instances, separation, purification, and characterization of homogeneous ADC where p is a certain value from ADC with other drug loadings may be achieved by means such as reverse phase HPLC or electrophoresis. Such techniques are also applicable to other types of conjugates.

For some antibody-drug conjugates, p may be limited by the number of attachment sites on the antibody. For example, an antibody may have only one or several cysteine thiol groups, or may have only one or several sufficiently reactive thiol groups through which a linker may be attached. Higher drug loading, e.g. p>5, may cause aggregation, insolubility, toxicity, or loss of cellular permeability of certain antibody-drug conjugates.

Typically, fewer than the theoretical maximum of drug moieties are conjugated to an antibody during a conjugation reaction. An antibody may contain, for example, many lysine residues that do not react with the drug-linker intermediate (D-L) or linker reagent. Only the most reactive lysine groups may react with an amine-reactive linker reagent. Also, only the most reactive cysteine thiol groups may react with a thiol-reactive linker reagent. Generally, antibodies do not contain many, if any, free and reactive cysteine thiol groups which may be linked to a drug moiety. Most cysteine thiol residues in the antibodies of the compounds exist as disulfide bridges and must be reduced with a reducing agent such as dithiothreitol (DTT) or TCEP, under partial or total reducing conditions. The loading (drug/antibody ratio) of an ADC may be controlled in several different manners, including: (i) limiting the molar excess of drug-linker intermediate (D-L) or linker reagent relative to antibody, (ii) limiting the conjugation reaction time or temperature, and (iii) partial or limiting reductive conditions for cysteine thiol modification.

Certain antibodies have reducible interchain disulfides, i.e. cysteine bridges. Antibodies may be made reactive for conjugation with linker reagents by treatment with a reducing agent such as DTT (dithiothreitol). Each cysteine bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol. Reactive thiol groups may be introduced into the antibody (or fragment thereof) by engineering one, two, three, four, or more cysteine residues (e.g., preparing mutant antibodies comprising one or more non-native cysteine amino acid residues). U.S. Pat. No. 7,521,541 teaches engineering antibodies by introduction of reactive cysteine amino acids.

Cysteine amino acids may be engineered at reactive sites in an antibody and which do not form intrachain or intermolecular disulfide linkages (Junutula, et al., 2008b Nature Biotech., 26(8):925-932; Dornan et al (2009) Blood 114 (13):2721-2729; U.S. Pat. No. 7,521,541; U.S. Pat. No. 7,723,485; WO2009/052249). The engineered cysteine thiols may react with linker reagents or the drug-linker reagents of the present invention which have thiol-reactive, electrophilic groups such as maleimide or alpha-halo amides to form ADC with cysteine engineered antibodies and the PBD drug moieties. The location of the drug moiety can thus be designed, controlled, and known. The drug loading can be controlled since the engineered cysteine thiol groups typically react with thiol-reactive linker reagents or drug-linker reagents in high yield. Engineering an IgG antibody to introduce a cysteine amino acid by substitution at a single site on the heavy or light chain gives two new cysteines on the symmetrical antibody.

A drug loading near 2 can be achieved with near homogeneity of the conjugation product ADC.

Where more than one nucleophilic or electrophilic group of the antibody reacts with a drug-linker intermediate, or linker reagent followed by drug moiety reagent, then the resulting product is a mixture of ADC compounds with a distribution of drug moieties attached to an antibody, e.g. 1, 2, 3, etc. Liquid chromatography methods such as polymeric reverse phase (PLRP) and hydrophobic interaction (HIC) may separate compounds in the mixture by drug loading value. Preparations of ADC with a single drug loading value (p) may be isolated, however, these single loading value ADCs may still be heterogeneous mixtures because the drug moieties may be attached, via the linker, at different sites on the antibody.

Thus the antibody-drug conjugate compositions of the invention include mixtures of antibody-drug conjugate compounds where the antibody has one or more PBD drug moieties and where the drug moieties may be attached to the antibody at various amino acid residues.

In one embodiment, the average number of dimer pyrrolobenzodiazepine groups per cell binding agent is in the range 1 to 20. In some embodiments the range is selected from 1 to 8, 2 to 8, 2 to 6, 2 to 4, and 4 to 8.

In some embodiments, there is one dimer pyrrolobenzodiazepine group per cell binding agent.

Preferred Compounds

Particularly preferred compounds of the first aspect of the present invention include:

Particularly preferred compounds of the second aspect of the present invention include:

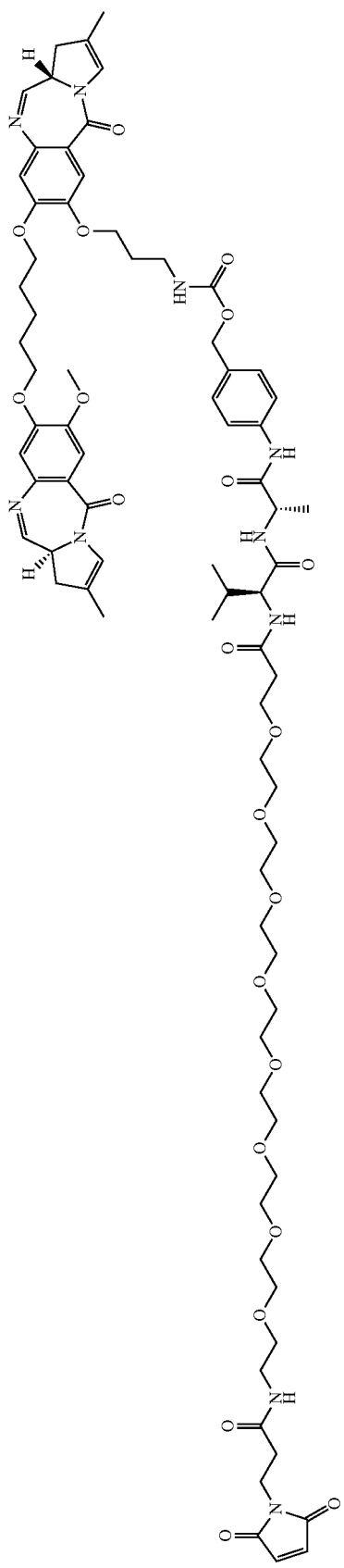

Particularly preferred compounds of the third aspect of the present invention include:

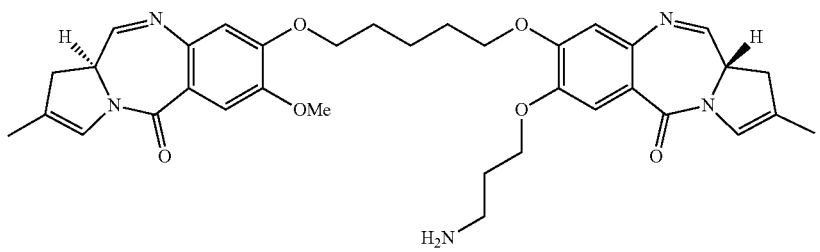

Substituents

The phrase "optionally substituted" as used herein, pertains to a parent group which may be unsubstituted or which may be substituted.

Unless otherwise specified, the term "substituted" as used herein, pertains to a parent group which bears one or more substituents. The term "substituent" is used herein in the conventional sense and refers to a chemical moiety which is covalently attached to, or if appropriate, fused to, a parent group. A wide variety of substituents are well known, and methods for their formation and introduction into a variety of parent groups are also well known.

In a preferred embodiment, the substituents described herein (which include optional substituents) are limited to those groups that are not reactive to a cell binding agent. The link to the cell binding agent in the present case is formed from the bridge between the two PBD moieties through a linker group to the cell binding agent. Reactive functional groups located at other parts of the PBD structure may be capable of forming additional bonds to the cell binding agent (this may be referred to as crosslinking). These additional bonds may alter transport and biological activity of the conjugate. Therefore, in some embodiment, the additional substituents are limited to those lacking reactive functionality.

In one embodiment, the substituents are selected from the group consisting of R, OR, SR, NRR', $NO_2$, halo, $CO_2R$, COR, $CONH_2$, CONHR, and CONRR'.

In one embodiment, the substituents are selected from the group consisting of R, OR, SR, NRR', $NO_2$, $CO_2R$, COR, $CONH_2$, CONHR, and CONRR'.

In one embodiment, the substituents are selected from the group consisting of R, OR, SR, NRR', $NO_2$, and halo.

In one embodiment, the substituents are selected from the group consisting of R, OR, SR, NRR', and $NO_2$.

Any one of the embodiment mentioned above may be applied to any one of the substituents described herein. Alternatively, the substituents may be selected from one or more of the groups listed below.

Examples of substituents are described in more detail below.

$C_{1-12}$ alkyl: The term "$C_{1-12}$ alkyl" as used herein, pertains to a monovalent moiety obtained by removing a hydrogen atom from a carbon atom of a hydrocarbon compound having from 1 to 12 carbon atoms, which may be aliphatic or alicyclic, and which may be saturated or unsaturated (e.g. partially unsaturated, fully unsaturated). Thus, the term "alkyl" includes the sub-classes alkenyl, alkynyl, cycloalkyl, etc., discussed below.

Examples of saturated alkyl groups include, but are not limited to, methyl ($C_1$), ethyl ($C_2$), propyl ($C_3$), butyl ($C_4$), pentyl ($C_5$), hexyl ($C_6$) and heptyl ($C_7$).

Examples of saturated linear alkyl groups include, but are not limited to, methyl ($C_1$), ethyl ($C_2$), n-propyl ($C_3$), n-butyl ($C_4$), n-pentyl (amyl) ($C_5$), n-hexyl ($C_6$) and n-heptyl ($C_7$).

Examples of saturated branched alkyl groups include iso-propyl ($C_3$), iso-butyl ($C_4$), sec-butyl ($C_4$), tert-butyl ($C_4$), iso-pentyl ($C_5$), and neo-pentyl ($C_5$).

An alkyl group may optionally be interrupted by one or more heteroatoms selected from O, N(H) and S. Such groups may be referred to as "heteroalkyl".

$C_{2-12}$ Heteroalkyl: The term "$C_{2-12}$ heteroalkyl" as used herein, pertains to a monovalent moiety obtained by removing a hydrogen atom from a carbon atom of a hydrocarbon compound having from 2 to 12 carbon atoms, and one or more heteroatoms selected from O, N(H) and S, preferably O and S.

Examples of heteroalkyl groups include, but are not limited to those comprising one or more ethylene glycol units of the type —($OCH_2CH_2$)—. The terminal of a heteroalkyl group may be the primary form of a heteroatom, e.g. —OH, —SH or —$NH_2$. In a preferred embodiment, the terminal is —$CH_3$.

$C_{2-12}$ Alkenyl: The term "$C_{2-12}$ alkenyl" as used herein, pertains to an alkyl group having one or more carbon-carbon double bonds.

Examples of unsaturated alkenyl groups include, but are not limited to, ethenyl (vinyl, —CH=$CH_2$), 1-propenyl (—CH=CH—$CH_3$), 2-propenyl (allyl, —CH—CH=$CH_2$), isopropenyl (1-methylvinyl, —C($CH_3$)=$CH_2$), butenyl ($C_4$), pentenyl ($C_5$), and hexenyl ($C_6$).

$C_{2-12}$ alkynyl: The term "$C_{2-12}$ alkynyl" as used herein, pertains to an alkyl group having one or more carbon-carbon triple bonds.

Examples of unsaturated alkynyl groups include, but are not limited to, ethynyl (—C≡CH) and 2-propynyl (propargyl, —$CH_2$—C≡CH).

$C_{3-12}$ cycloalkyl: The term "$C_{3-12}$ cycloalkyl" as used herein, pertains to an alkyl group which is also a cyclyl group; that is, a monovalent moiety obtained by removing a hydrogen atom from an alicyclic ring atom of a cyclic hydrocarbon (carbocyclic) compound, which moiety has from 3 to 7 carbon atoms, including from 3 to 7 ring atoms.

Examples of cycloalkyl groups include, but are not limited to, those derived from:
saturated monocyclic hydrocarbon compounds: cyclopropane ($C_3$), cyclobutane ($C_4$), cyclopentane ($C_5$), cyclohexane ($C_6$), cycloheptane ($C_7$), methylcyclopropane ($C_4$), dimethylcyclopropane ($C_5$), methylcyclobutane ($C_5$), dimethylcyclobutane ($C_6$), methylcyclopentane ($C_6$), dimethylcyclopentane ($C_7$) and methylcyclohexane ($C_7$);

unsaturated monocyclic hydrocarbon compounds:
cyclopropene ($C_3$), cyclobutene ($C_4$), cyclopentene ($C_5$), cyclohexene ($C_6$), methylcyclopropene ($C_4$), dimethylcyclopropene ($C_5$), methylcyclobutene ($C_5$), dimethylcyclobutene ($C_6$), methylcyclopentene ($C_6$), dimethylcyclopentene ($C_7$) and methylcyclohexene ($C_7$); and saturated polycyclic hydrocarbon compounds:
norcarane ($C_7$), norpinane ($C_7$), norbornane ($C_7$).

$C_{3-20}$ heterocyclyl: The term "$C_{3-20}$ heterocyclyl" as used herein, pertains to a monovalent moiety obtained by removing a hydrogen atom from a ring atom of a heterocyclic compound, which moiety has from 3 to 20 ring atoms, of which from 1 to 10 are ring heteroatoms. Preferably, each ring has from 3 to 7 ring atoms, of which from 1 to 4 are ring heteroatoms.

In this context, the prefixes (e.g. $C_{3-20}$, $C_{3-7}$, $C_{5-6}$, etc.) denote the number of ring atoms, or range of number of ring atoms, whether carbon atoms or heteroatoms. For example, the term "$C_{5-6}$heterocyclyl", as used herein, pertains to a heterocyclyl group having 5 or 6 ring atoms.

Examples of monocyclic heterocyclyl groups include, but are not limited to, those derived from:
$N_1$: aziridine ($C_3$), azetidine ($C_4$), pyrrolidine (tetrahydropyrrole) ($C_5$), pyrroline (e.g., 3-pyrroline, 2,5-dihydropyrrole) ($C_5$), 2H-pyrrole or 3H-pyrrole (isopyrrole, isoazole) ($C_5$), piperidine ($C_6$), dihydropyridine ($C_6$), tetrahydropyridine ($C_6$), azepine ($C_7$);
$O_1$: oxirane ($C_3$), oxetane ($C_4$), oxolane (tetrahydrofuran) ($C_5$), oxole (dihydrofuran) ($C_5$), oxane (tetrahydropyran) ($C_6$), dihydropyran ($C_6$), pyran ($C_6$), oxepin ($C_7$);
$S_1$: thiirane ($C_3$), thietane ($C_4$), thiolane (tetrahydrothiophene) ($C_5$), thiane (tetrahydrothiopyran) ($C_6$), thiepane ($C_7$);
$O_2$: dioxolane ($C_5$), dioxane ($C_6$), and dioxepane ($C_7$);
$O_3$: trioxane ($C_6$);
$N_2$: imidazolidine ($C_5$), pyrazolidine (diazolidine) ($C_5$), imidazoline ($C_5$), pyrazoline (dihydropyrazole) ($C_5$), piperazine ($C_6$);
$N_1O_1$: tetrahydrooxazole ($C_5$), dihydrooxazole ($C_5$), tetrahydroisoxazole ($C_5$), dihydroisoxazole ($C_5$), morpholine ($C_6$), tetrahydrooxazine ($C_6$), dihydrooxazine ($C_6$), oxazine ($C_6$);
$N_1S_1$: thiazoline ($C_5$), thiazolidine ($C_5$), thiomorpholine ($C_6$);
$N_2O_1$: oxadiazine ($C_6$);
$O_1S_1$: oxathiole ($C_5$) and oxathiane (thioxane) ($C_6$); and, $N_1O_1S_1$: oxathiazine ($C_6$).

Examples of substituted monocyclic heterocyclyl groups include those derived from saccharides, in cyclic form, for example, furanoses ($C_5$), such as arabinofuranose, lyxofuranose, ribofuranose, and xylofuranse, and pyranoses ($C_6$), such as allopyranose, altropyranose, glucopyranose, mannopyranose, gulopyranose, idopyranose, galactopyranose, and talopyranose.

$C_{5-20}$ aryl: The term "$C_{5-20}$ aryl", as used herein, pertains to a monovalent moiety obtained by removing a hydrogen atom from an aromatic ring atom of an aromatic compound, which moiety has from 3 to 20 ring atoms. Preferably, each ring has from 5 to 7 ring atoms.

In this context, the prefixes (e.g. $C_{3-20}$, $C_{5-7}$, $C_{5-6}$, etc.) denote the number of ring atoms, or range of number of ring atoms, whether carbon atoms or heteroatoms. For example, the term "$C_{5-6}$ aryl" as used herein, pertains to an aryl group having 5 or 6 ring atoms.

The ring atoms may be all carbon atoms, as in "carboaryl groups".

Examples of carboaryl groups include, but are not limited to, those derived from benzene (i.e. phenyl) ($C_6$), naphthalene ($C_{10}$), azulene ($C_{10}$), anthracene ($C_{14}$), phenanthrene ($C_{14}$), naphthacene ($C_{18}$), and pyrene ($C_{16}$).

Examples of aryl groups which comprise fused rings, at least one of which is an aromatic ring, include, but are not limited to, groups derived from indane (e.g. 2,3-dihydro-1H-indene) ($C_9$), indene ($C_9$), isoindene ($C_9$), tetraline (1,2,3,4-tetrahydronaphthalene) ($C_{10}$), acenaphthene ($C_{12}$), fluorene ($C_{13}$), phenalene ($C_{13}$), acephenanthrene ($C_{15}$), and aceanthrene ($C_{16}$).

Alternatively, the ring atoms may include one or more heteroatoms, as in "heteroaryl groups". Examples of monocyclic heteroaryl groups include, but are not limited to, those derived from:
$N_1$: pyrrole (azole) ($C_5$), pyridine (azine) ($C_6$);
$O_1$: furan (oxole) ($C_5$);
$S_1$: thiophene (thiole) ($C_5$);
$N_1O_1$: oxazole ($C_5$), isoxazole ($C_5$), isoxazine ($C_6$);
$N_2O_1$: oxadiazole (furazan) ($C_5$);
$N_3O_1$: oxatriazole ($C_5$);
$N_1S_1$: thiazole ($C_5$), isothiazole ($C_5$);
$N_2$: imidazole (1,3-diazole) ($C_5$), pyrazole (1,2-diazole) ($C_5$), pyridazine (1,2-diazine) ($C_6$), pyrimidine (1,3-diazine) ($C_6$) (e.g., cytosine, thymine, uracil), pyrazine (1,4-diazine) ($C_6$);
$N_3$: triazole ($C_5$), triazine ($C_6$); and,
$N_4$: tetrazole ($C_5$).

Examples of heteroaryl which comprise fused rings, include, but are not limited to:
$C_9$ (with 2 fused rings) derived from benzofuran ($O_1$), isobenzofuran ($O_1$), indole ($N_1$), isoindole ($N_1$), indolizine ($N_1$), indoline ($N_1$), isoindoline ($N_1$), purine ($N_4$) (e.g., adenine, guanine), benzimidazole ($N_2$), indazole ($N_2$), benzoxazole ($N_1O_1$), benzisoxazole ($N_1O_1$), benzodioxole ($C_2$), benzofurazan ($N_2O_1$), benzotriazole ($N_3$), benzothiofuran ($S_1$), benzothiazole ($N_1S_1$), benzothiadiazole ($N_2S$);
$C_{10}$ (with 2 fused rings) derived from chromene ($O_1$), isochromene ($O_1$), chroman ($O_1$), isochroman ($O_1$), benzodioxan ($O_2$), quinoline ($N_1$), isoquinoline ($N_1$), quinolizine ($N_1$), benzoxazine ($N_1O_1$), benzodiazine ($N_2$), pyridopyridine ($N_2$), quinoxaline ($N_2$), quinazoline ($N_2$), cinnoline ($N_2$), phthalazine ($N_2$), naphthyridine ($N_2$), pteridine ($N_4$);
$C_{11}$ (with 2 fused rings) derived from benzodiazepine ($N_2$);
$C_{13}$ (with 3 fused rings) derived from carbazole ($N_1$), dibenzofuran ($O_1$), dibenzothiophene ($S_1$), carboline ($N_2$), perimidine ($N_2$), pyridoindole ($N_2$); and,
$C_{14}$ (with 3 fused rings) derived from acridine ($N_1$), xanthene ($O_1$), thioxanthene ($S_1$), oxanthrene ($O_2$), phenoxathiin ($O_1S_1$), phenazine ($N_2$), phenoxazine ($N_1O_1$), phenothiazine ($N_1S_1$), thianthrene ($S_2$), phenanthridine ($N_1$), phenanthroline ($N_2$), phenazine ($N_2$).

The above groups, whether alone or part of another substituent, may themselves optionally be substituted with one or more groups selected from themselves and the additional substituents listed below.

Halo: —F, —Cl, —Br, and —I.
Hydroxy: —OH.
Ether: —OR, wherein R is an ether substituent, for example, a $C_{1-7}$ alkyl group (also referred to as a $C_{1-7}$ alkoxy group, discussed below), a $C_{3-20}$ heterocyclyl group (also referred to as a $C_{3-20}$ heterocyclyloxy group), or a $C_{5-20}$ aryl group (also referred to as a $C_{5-20}$ aryloxy group), preferably a $C_{1-7}$alkyl group.

Alkoxy: —OR, wherein R is an alkyl group, for example, a $C_{1-7}$ alkyl group. Examples of $C_{1-7}$ alkoxy groups include, but are not limited to, —OMe (methoxy), —OEt (ethoxy), —O(nPr) (n-propoxy), —O(iPr) (isopropoxy), —O(nBu) (n-butoxy), —O(sBu) (sec-butoxy), —O(iBu) (isobutoxy), and —O(tBu) (tert-butoxy).

Acetal: —CH(OR$^1$)(OR$^2$), wherein R$^1$ and R$^2$ are independently acetal substituents, for example, a $C_{1-7}$ alkyl group, a $C_{3-20}$ heterocyclyl group, or a $C_{5-20}$ aryl group, preferably a $C_{1-7}$ alkyl group, or, in the case of a "cyclic" acetal group, R$^1$ and R$^2$, taken together with the two oxygen atoms to which they are attached, and the carbon atoms to which they are attached, form a heterocyclic ring having from 4 to 8 ring atoms. Examples of acetal groups include, but are not limited to, —CH(OMe)$_2$, —CH(OEt)$_2$, and —CH(OMe)(OEt).

Hemiacetal: —CH(OH)(OR$^1$), wherein R$^1$ is a hemiacetal substituent, for example, a $C_{1-7}$ alkyl group, a $C_{3-20}$ heterocyclyl group, or a $C_{5-20}$ aryl group, preferably a $C_{1-7}$ alkyl group. Examples of hemiacetal groups include, but are not limited to, —CH(OH)(OMe) and —CH(OH)(OEt).

Ketal: —CR(OR$^1$)(OR$^2$), where R$^1$ and R$^2$ are as defined for acetals, and R is a ketal substituent other than hydrogen, for example, a $C_{1-7}$ alkyl group, a $C_{3-20}$ heterocyclyl group, or a $C_{5-20}$ aryl group, preferably a $C_{1-7}$ alkyl group. Examples ketal groups include, but are not limited to, —C(Me)(OMe)$_2$, —C(Me)(OEt)$_2$, —C(Me)(OMe)(OEt), —C(Et)(OMe)$_2$, —C(Et)(OEt)$_2$, and —C(Et)(OMe)(OEt).

Hemiketal: —CR(OH)(OR$^1$), where R$^1$ is as defined for hemiacetals, and R is a hemiketal substituent other than hydrogen, for example, a $C_{1-7}$ alkyl group, a $C_{3-20}$ heterocyclyl group, or a $C_{5-20}$ aryl group, preferably a $C_{1-7}$ alkyl group. Examples of hemiacetal groups include, but are not limited to, —C(Me)(OH)(OMe), —C(Et)(OH)(OMe), —C(Me)(OH)(OEt), and —C(Et)(OH)(OEt).

Oxo (keto, -one): =O.

Thione (thioketone): =S.

Imino (imine): =NR, wherein R is an imino substituent, for example, hydrogen, $C_{1-7}$ alkyl group, a $C_{3-20}$ heterocyclyl group, or a $C_{5-20}$ aryl group, preferably hydrogen or a $C_{1-7}$ alkyl group. Examples of ester groups include, but are not limited to, =NH, =NMe, =NEt, and =NPh.

Formyl (carbaldehyde, carboxaldehyde): —C(=O)H.

Acyl (keto): —C(=O)R, wherein R is an acyl substituent, for example, a $C_{1-7}$ alkyl group (also referred to as $C_{1-7}$ alkylacyl or $C_{1-7}$ alkanoyl), a $C_{3-20}$ heterocyclyl group (also referred to as $C_{3-20}$ heterocyclylacyl), or a $C_{5-20}$ aryl group (also referred to as $C_{5-20}$ arylacyl), preferably a $C_{1-7}$ alkyl group. Examples of acyl groups include, but are not limited to, —C(=O)CH$_3$ (acetyl), —C(=O)CH$_2$CH$_3$ (propionyl), —C(=O)C(CH$_3$)$_3$ (t-butyryl), and —C(=O)Ph (benzoyl, phenone).

Carboxy (carboxylic acid): —C(=O)OH.

Thiocarboxy (thiocarboxylic acid): —C(=S)SH.

Thiolocarboxy (thiolocarboxylic acid): —C(=O)SH.

Thionocarboxy (thionocarboxylic acid): —C(=S)OH.

Imidic acid: —C(=NH)OH.

Hydroxamic acid: —C(=NOH)OH.

Ester (carboxylate, carboxylic acid ester, oxycarbonyl): —C(=O)OR, wherein R is an ester substituent, for example, a $C_{1-7}$ alkyl group, a $C_{3-20}$ heterocyclyl group, or a $C_{5-20}$ aryl group, preferably a $C_{1-7}$ alkyl group. Examples of ester groups include, but are not limited to, —C(=O)OCH$_3$, —C(=O)OCH$_2$CH$_3$, —C(=O)OC(CH$_3$)$_3$, and —C(=O)OPh.

Acyloxy (reverse ester): —OC(=O)R, wherein R is an acyloxy substituent, for example, a $C_{1-7}$ alkyl group, a $C_{3-20}$ heterocyclyl group, or a $C_{5-20}$ aryl group, preferably a $C_{1-7}$ alkyl group. Examples of acyloxy groups include, but are not limited to, —OC(=O)CH$_3$ (acetoxy), —OC(=O)CH$_2$CH$_3$, —OC(=O)C(CH$_3$)$_3$, —OC(=O)Ph, and —OC(=O)CH$_2$Ph.

Oxycarboyloxy: —OC(=O)OR, wherein R is an ester substituent, for example, a $C_{1-7}$ alkyl group, a $C_{3-20}$ heterocyclyl group, or a $C_{5-20}$ aryl group, preferably a $C_{1-7}$ alkyl group. Examples of ester groups include, but are not limited to, —OC(=O)OCH$_3$, —OC(=O)OCH$_2$CH$_3$, —OC(=O)OC(CH$_3$)$_3$, and —OC(=O)OPh.

Amino: —NR$^1$R$^2$, wherein R$^1$ and R$^2$ are independently amino substituents, for example, hydrogen, a $C_{1-7}$ alkyl group (also referred to as $C_{1-7}$ alkylamino or di-$C_{1-7}$ alkylamino), a $C_{3-20}$ heterocyclyl group, or a $C_{5-20}$ aryl group, preferably H or a $C_{1-7}$ alkyl group, or, in the case of a "cyclic" amino group, R$^1$ and R$^2$, taken together with the nitrogen atom to which they are attached, form a heterocyclic ring having from 4 to 8 ring atoms. Amino groups may be primary (—NH$_2$), secondary (—NHR$^1$), or tertiary (—NHR$^1$R$^2$), and in cationic form, may be quaternary (—$^+$NR$^1$R$^2$R$^3$). Examples of amino groups include, but are not limited to, —NH$_2$, —NHCH$_3$, —NHC(CH$_3$)$_2$, —N(CH$_3$)$_2$, —N(CH$_2$CH$_3$)$_2$, and —NHPh. Examples of cyclic amino groups include, but are not limited to, aziridino, azetidino, pyrrolidino, piperidino, piperazino, morpholino, and thiomorpholino.

Amido (carbamoyl, carbamyl, aminocarbonyl, carboxamide): —C(=O)NR$^1$R$^2$, wherein R$^1$ and R$^2$ are independently amino substituents, as defined for amino groups. Examples of amido groups include, but are not limited to, —C(=O)NH$_2$, —C(=O)NHCH$_3$, —C(=O)N(CH$_3$)$_2$, —C(=O)NHCH$_2$CH$_3$, and —C(=O)N(CH$_2$CH$_3$)$_2$, as well as amido groups in which R$^1$ and R$^2$, together with the nitrogen atom to which they are attached, form a heterocyclic structure as in, for example, piperidinocarbonyl, morpholinocarbonyl, thiomorpholinocarbonyl, and piperazinocarbonyl.

Thioamido (thiocarbamyl): —C(=S)NR$^1$R$^2$, wherein R$^1$ and R$^2$ are independently amino substituents, as defined for amino groups. Examples of amido groups include, but are not limited to, —C(=S)NH$_2$, —C(=S)NHCH$_3$, —C(=S)N(CH$_3$)$_2$, and —C(=S)NHCH$_2$CH$_3$.

Acylamido (acylamino): —NR$^1$C(=O)R$^2$, wherein R$^1$ is an amide substituent, for example, hydrogen, a $C_{1-7}$ alkyl group, a $C_{3-20}$ heterocyclyl group, or a $C_{5-20}$ aryl group, preferably hydrogen or a $C_{1-7}$ alkyl group, and R$^2$ is an acyl substituent, for example, a $C_{1-7}$ alkyl group, a $C_{3-20}$ heterocyclyl group, or a $C_{5-20}$aryl group, preferably hydrogen or a $C_{1-7}$ alkyl group. Examples of acylamide groups include, but are not limited to, —NHC(=O)CH$_3$, —NHC(=O)CH$_2$CH$_3$, and —NHC(=O)Ph. R$^1$ and R$^2$ may together form a cyclic structure, as in, for example, succinimidyl, maleimidyl, and phthalimidyl:

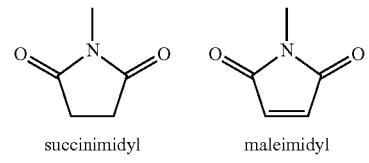

succinimidyl     maleimidyl

-continued

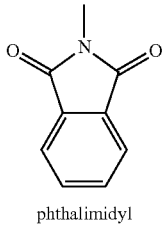
phthalimidyl

Aminocarbonyloxy: —OC(=O)NR$^1$R$^2$, wherein R$^1$ and R$^2$ are independently amino substituents, as defined for amino groups. Examples of aminocarbonyloxy groups include, but are not limited to, —OC(=O)NH$_2$, —OC(=O)NHMe, —OC(=O)NMe$_2$, and —OC(=O)NEt$_2$.

Ureido: —N(R$^1$)CONR$^2$R$^3$ wherein R$^2$ and R$^3$ are independently amino substituents, as defined for amino groups, and R$^1$ is a ureido substituent, for example, hydrogen, a C$_{1-7}$ alkyl group, a C$_{3-20}$ heterocyclyl group, or a C$_{5-20}$ aryl group, preferably hydrogen or a C$_{1-7}$ alkyl group. Examples of ureido groups include, but are not limited to, —NHCONH$_2$, —NHCONHMe, —NHCONHEt, —NHCONMe$_2$, —NHCONEt$_2$, —NMeCONH$_2$, —NMeCONHMe, —NMeCONHEt, —NMeCONMe$_2$, and —NMeCONEt$_2$.

Guanidino: —NH—C(=NH)NH$_2$.

Tetrazolyl: a five membered aromatic ring having four nitrogen atoms and one carbon atom,

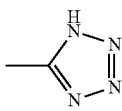

Imino: =NR, wherein R is an imino substituent, for example, for example, hydrogen, a C$_{1-7}$ alkyl group, a C$_{3-20}$ heterocyclyl group, or a C$_{5-20}$ aryl group, preferably H or a C$_{1-7}$ alkyl group. Examples of imino groups include, but are not limited to, =NH, =NMe, and =NEt.

Amidine (amidino): —C(=NR)NR$_2$, wherein each R is an amidine substituent, for example, hydrogen, a C$_{1-7}$ alkyl group, a C$_{3-20}$ heterocyclyl group, or a C$_{5-20}$ aryl group, preferably H or a C$_{1-7}$ alkyl group. Examples of amidine groups include, but are not limited to, —C(=NH)NH$_2$, —C(=NH)NMe$_2$, and —C(=NMe)NMe$_2$.

Nitro: —NO$_2$.
Nitroso: —NO.
Azido: —N$_3$.
Cyano (nitrile, carbonitrile): —CN.
Isocyano: —NC.
Cyanato: —OCN.
Isocyanato: —NCO.
Thiocyano (thiocyanato): —SCN.
Isothiocyano (isothiocyanato): —NCS.
Sulfhydryl (thiol, mercapto): —SH.
Thioether (sulfide): —SR, wherein R is a thioether substituent, for example, a C$_{1-7}$ alkyl group (also referred to as a C$_{1-7}$alkylthio group), a C$_{3-20}$ heterocyclyl group, or a C$_{5-20}$ aryl group, preferably a C$_{1-7}$ alkyl group. Examples of C$_{1-7}$ alkylthio groups include, but are not limited to, —SCH$_3$ and —SCH$_2$CH$_3$.

Disulfide: —SS—R, wherein R is a disulfide substituent, for example, a C$_{1-7}$ alkyl group, a C$_{3-20}$ heterocyclyl group, or a C$_{5-20}$ aryl group, preferably a C$_{1-7}$ alkyl group (also referred to herein as C$_{1-7}$ alkyl disulfide). Examples of C$_{1-7}$ alkyl disulfide groups include, but are not limited to, —SSCH$_3$ and —SSCH$_2$CH$_3$.

Sulfine (sulfinyl, sulfoxide): —S(=O)R, wherein R is a sulfine substituent, for example, a C$_{1-7}$ alkyl group, a C$_{3-20}$ heterocyclyl group, or a C$_{5-20}$ aryl group, preferably a C$_{1-7}$ alkyl group. Examples of sulfine groups include, but are not limited to, —S(=O)CH$_3$ and —S(=O)CH$_2$CH$_3$.

Sulfone (sulfonyl): —S(=O)$_2$R, wherein R is a sulfone substituent, for example, a C$_{1-7}$ alkyl group, a C$_{3-20}$ heterocyclyl group, or a C$_{5-20}$ aryl group, preferably a C$_{1-7}$ alkyl group, including, for example, a fluorinated or perfluorinated C$_{1-7}$ alkyl group. Examples of sulfone groups include, but are not limited to, —S(=O)$_2$CH$_3$ (methanesulfonyl, mesyl), —S(=O)$_2$CF$_3$ (triflyl), —S(=O)$_2$CH$_2$CH$_3$ (esyl), —S(=O)$_2$C$_4$F$_9$ (nonaflyl), —S(=O)$_2$CH$_2$CF$_3$ (tresyl), —S(=O)$_2$CH$_2$CH$_2$NH$_2$ (tauryl), —S(=O)$_2$Ph (phenylsulfonyl, besyl), 4-methylphenylsulfonyl (tosyl), 4-chlorophenylsulfonyl (closyl), 4-bromophenylsulfonyl (brosyl), 4-nitrophenyl (nosyl), 2-naphthalenesulfonate (napsyl), and 5-dimethylamino-naphthalen-1-ylsulfonate (dansyl).

Sulfinic acid (sulfino): —S(=O)OH, —SO$_2$H.
Sulfonic acid (sulfo): —S(=O)$_2$OH, —SO$_3$H.

Sulfinate (sulfinic acid ester): —S(=O)OR; wherein R is a sulfinate substituent, for example, a C$_{1-7}$ alkyl group, a C$_{3-20}$ heterocyclyl group, or a C$_{5-20}$ aryl group, preferably a C$_{1-7}$ alkyl group. Examples of sulfinate groups include, but are not limited to, —S(=O)OCH$_3$ (methoxysulfinyl; methyl sulfinate) and —S(=O)OCH$_2$CH$_3$ (ethoxysulfinyl; ethyl sulfinate).

Sulfonate (sulfonic acid ester): —S(=O)$_2$OR, wherein R is a sulfonate substituent, for example, a C$_{1-7}$ alkyl group, a C$_{3-20}$ heterocyclyl group, or a C$_{5-20}$ aryl group, preferably a C$_{1-7}$ alkyl group. Examples of sulfonate groups include, but are not limited to, —S(=O)$_2$OCH$_3$ (methoxysulfonyl; methyl sulfonate) and —S(=O)$_2$OCH$_2$CH$_3$ (ethoxysulfonyl; ethyl sulfonate).

Sulfinyloxy: —OS(=O)R, wherein R is a sulfinyloxy substituent, for example, a C$_{1-7}$ alkyl group, a C$_{3-20}$ heterocyclyl group, or a C$_{5-20}$ aryl group, preferably a C$_{1-7}$ alkyl group. Examples of sulfinyloxy groups include, but are not limited to, —OS(=O)CH$_3$ and —OS(=O)CH$_2$CH$_3$.

Sulfonyloxy: —OS(=O)$_2$R, wherein R is a sulfonyloxy substituent, for example, a C$_{1-7}$ alkyl group, a C$_{3-20}$ heterocyclyl group, or a C$_{5-20}$ aryl group, preferably a C$_{1-7}$ alkyl group. Examples of sulfonyloxy groups include, but are not limited to, —OS(=O)$_2$CH$_3$ (mesylate) and —OS(=O)$_2$CH$_2$CH$_3$ (esylate).

Sulfate: —OS(=O)$_2$OR; wherein R is a sulfate substituent, for example, a C$_{1-7}$ alkyl group, a C$_{3-20}$ heterocyclyl group, or a C$_{5-20}$ aryl group, preferably a C$_{1-7}$ alkyl group. Examples of sulfate groups include, but are not limited to, —OS(=O)$_2$OCH$_3$ and —SO(=O)$_2$OCH$_2$CH$_3$.

Sulfamyl (sulfamoyl; sulfinic acid amide; sulfinamide): —S(=O)NR$^1$R$^2$, wherein R$^1$ and R$^2$ are independently amino substituents, as defined for amino groups. Examples of sulfamyl groups include, but are not limited to, —S(=O)NH$_2$, —S(=O)NH(CH$_3$), —S(=O)N(CH$_3$)$_2$, —S(=O)NH(CH$_2$CH$_3$), —S(=O)N(CH$_2$CH$_3$)$_2$, and —S(=O)NHPh.

Sulfonamido (sulfinamoyl; sulfonic acid amide; sulfonamide): —S(=O)$_2$NR$^1$R$^2$, wherein R$^1$ and R$^2$ are independently amino substituents, as defined for amino groups. Examples of sulfonamido groups include, but are not limited to, —S(=O)$_2$NH$_2$, —S(=O)$_2$NH(CH$_3$), —S(=O)$_2$N(CH$_3$)$_2$, —S(=O)$_2$NH(CH$_2$CH$_3$), —S(=O)$_2$N(CH$_2$CH$_3$)$_2$, and —S(=O)$_2$NHPh.

Sulfamino: —NR$^1$S(=O)$_2$OH, wherein R$^1$ is an amino substituent, as defined for amino groups. Examples of sulfamino groups include, but are not limited to, —NHS(=O)$_2$OH and —N(CH$_3$)S(=O)$_2$OH.

Sulfonamino: —NR$^1$S(=O)$_2$R, wherein R$^1$ is an amino substituent, as defined for amino groups, and R is a sulfonamino substituent, for example, a C$_{1-7}$ alkyl group, a C$_{3-20}$ heterocyclyl group, or a C$_{5-20}$ aryl group, preferably a C$_{1-7}$ alkyl group. Examples of sulfonamino groups include, but are not limited to, —NHS(=O)$_2$CH$_3$ and —N(CH$_3$)S(=O)$_2$C$_6$H$_5$.

Sulfinamino: —NR$^1$S(=O)R, wherein R$^1$ is an amino substituent, as defined for amino groups, and R is a sulfinamino substituent, for example, a C$_{1-7}$ alkyl group, a C$_{3-20}$ heterocyclyl group, or a C$_{5-20}$ aryl group, preferably a C$_{1-7}$ alkyl group. Examples of sulfinamino groups include, but are not limited to, —NHS(=O)CH$_3$ and —N(CH$_3$)S(=O)C$_6$H$_5$.

Phosphino (phosphine): —PR$_2$, wherein R is a phosphino substituent, for example, —H, a C$_{1-7}$ alkyl group, a C$_{3-20}$ heterocyclyl group, or a C$_{5-20}$ aryl group, preferably —H, a C$_{1-7}$ alkyl group, or a C$_{5-20}$ aryl group. Examples of phosphino groups include, but are not limited to, —PH$_2$, —P(CH$_3$)$_2$, —P(CH$_2$CH$_3$)$_2$, —P(t-Bu)$_2$, and —P(Ph)$_2$.

Phospho: —P(=O)$_2$.

Phosphinyl (phosphine oxide): —P(=O)R$_2$, wherein R is a phosphinyl substituent, for example, a C$_{1-7}$ alkyl group, a C$_{3-20}$ heterocyclyl group, or a C$_{5-20}$ aryl group, preferably a C$_{1-7}$ alkyl group or a C$_{5-20}$ aryl group. Examples of phosphinyl groups include, but are not limited to, —P(=O)(CH$_3$)$_2$, —P(=O)(CH$_2$CH$_3$)$_2$, —P(=O)(t-Bu)$_2$, and —P(=O)(Ph)$_2$.

Phosphonic acid (phosphono): —P(=O)(OH)$_2$.

Phosphonate (phosphono ester): —P(=O)(OR)$_2$, where R is a phosphonate substituent, for example, —H, a C$_{1-7}$ alkyl group, a C$_{3-20}$ heterocyclyl group, or a C$_{5-20}$ aryl group, preferably —H, a C$_{1-7}$ alkyl group, or a C$_{5-20}$ aryl group. Examples of phosphonate groups include, but are not limited to, —P(=O)(OCH$_3$)$_2$, —P(=O)(OCH$_2$CH$_3$)$_2$, —P(=O)(O-t-Bu)$_2$, and —P(=O)(OPh)$_2$.

Phosphoric acid (phosphonooxy): —OP(=O)(OH)$_2$.

Phosphate (phosphonooxy ester): —OP(=O)(OR)$_2$, where R is a phosphate substituent, for example, —H, a C$_{1-7}$ alkyl group, a C$_{3-20}$ heterocyclyl group, or a C$_{5-20}$ aryl group, preferably —H, a C$_{1-7}$ alkyl group, or a C$_{5-20}$ aryl group. Examples of phosphate groups include, but are not limited to, —OP(=O)(OCH$_3$)$_2$, —OP(=O)(OCH$_2$CH$_3$)$_2$, —OP(=O)(O-t-Bu)$_2$, and —OP(=O)(OPh)$_2$.

Phosphorous acid: —OP(OH)$_2$.

Phosphite: —OP(OR)$_2$, where R is a phosphite substituent, for example, —H, a C$_{1-7}$ alkyl group, a C$_{3-20}$ heterocyclyl group, or a C$_{5-20}$ aryl group, preferably —H, a C$_{1-7}$ alkyl group, or a C$_{5-20}$ aryl group. Examples of phosphite groups include, but are not limited to, —OP(OCH$_3$)$_2$, —OP(OCH$_2$CH$_3$)$_2$, —OP(O-t-Bu)$_2$, and —OP(OPh)$_2$.

Phosphoramidite: —OP(OR$^1$)—NR$^{22}$, where R$^1$ and R$^2$ are phosphoramidite substituents, for example, —H, a (optionally substituted) C$_{1-7}$ alkyl group, a C$_{3-20}$ heterocyclyl group, or a C$_{5-20}$ aryl group, preferably —H, a C$_{1-7}$ alkyl group, or a C$_{5-20}$ aryl group. Examples of phosphoramidite groups include, but are not limited to, —OP(OCH$_2$CH$_3$)—N(CH$_3$)$_2$, —OP(OCH$_2$CH$_3$)—N(i-Pr)$_2$, and —OP(OCH$_2$CH$_2$CN)—N(i-Pr)$_2$.

Phosphoramidate: —OP(=O)(OR$^1$)—NR$^{22}$, where R$^1$ and R$^2$ are phosphoramidate substituents, for example, —H, a (optionally substituted) C$_{1-7}$ alkyl group, a C$_{3-20}$ heterocyclyl group, or a C$_{5-20}$ aryl group, preferably —H, a C$_{1-7}$ alkyl group, or a C$_{5-20}$ aryl group. Examples of phosphoramidate groups include, but are not limited to, —OP(=O)(OCH$_2$CH$_3$)—N(CH$_3$)$_2$, —OP(=O)(OCH$_2$CH$_3$)—N(i-Pr)$_2$, and —OP(=O)(OCH$_2$CH$_2$CN)—N(i-Pr)$_2$.

Alkylene

C$_{3-12}$ alkylene: The term "C$_{3-12}$ alkylene", as used herein, pertains to a bidentate moiety obtained by removing two hydrogen atoms, either both from the same carbon atom, or one from each of two different carbon atoms, of a hydrocarbon compound having from 3 to 12 carbon atoms (unless otherwise specified), which may be aliphatic or alicyclic, and which may be saturated, partially unsaturated, or fully unsaturated. Thus, the term "alkylene" includes the subclasses alkenylene, alkynylene, cycloalkylene, etc., discussed below.

Examples of linear saturated C$_{3-12}$ alkylene groups include, but are not limited to, —(CH$_2$)$_n$— where n is an integer from 3 to 12, for example, —CH$_2$CH$_2$CH$_2$— (propylene), —CH$_2$CH$_2$CH$_2$CH$_2$— (butylene), —CH$_2$CH$_2$CH$_2$CH$_2$CH$_2$— (pentylene) and —CH$_2$CH$_2$CH$_2$CH—$_2$CH$_2$CH$_2$CH$_2$— (heptylene).

Examples of branched saturated C$_{3-12}$alkylene groups include, but are not limited to, —CH(CH$_3$)CH$_2$—, —CH(CH$_3$)CH$_2$CH$_2$—, —CH(CH$_3$)CH$_2$CH$_2$CH$_2$—, —CH$_2$CH(CH$_3$)CH$_2$—, —CH$_2$CH(CH$_3$)CH$_2$CH$_2$—, —CH(CH$_2$CH$_3$)—, —CH(CH$_2$CH$_3$)CH$_2$—, and —CH$_2$CH(CH$_2$CH$_3$)CH$_2$—.

Examples of linear partially unsaturated C$_{3-12}$ alkylene groups (C$_{3-12}$ alkenylene, and alkynylene groups) include, but are not limited to, —CH=CH—CH$_2$—, —CH$_2$—CH=CH$_2$—, —CH=CH—CH$_2$—CH$_2$—, —CH=CH—CH$_2$—CH$_2$—CH$_2$—, —CH=CH—CH=CH—, —CH=CH—CH=CH—CH$_2$—, —CH=CH—CH$_2$—CH$_2$—, —CH=CH—CH$_2$—CH=CH—, —CH=CH—CH$_2$—CH$_2$—CH=CH—, and —CH$_2$—C≡C—CH$_2$—.

Examples of branched partially unsaturated C$_{3-12}$ alkylene groups (C$_{3-12}$ alkenylene and alkynylene groups) include, but are not limited to, —C(CH$_3$)=CH—, —C(CH$_3$)=CH—CH$_2$—, —CH=CH—CH(CH$_3$)— and —C≡C—CH(CH$_3$)—.

Examples of alicyclic saturated C$_{3-12}$ alkylene groups (C$_{3-12}$ cycloalkylenes) include, but are not limited to, cyclopentylene (e.g. cyclopent-1,3-ylene), and cyclohexylene (e.g. cyclohex-1,4-ylene).

Examples of alicyclic partially unsaturated C$_{3-12}$ alkylene groups (C$_{3-12}$ cycloalkylenes) include, but are not limited to, cyclopentenylene (e.g. 4-cyclopenten-1,3-ylene), cyclohexenylene (e.g. 2-cyclohexen-1,4-ylene; 3-cyclohexen-1,2-ylene; 2,5-cyclohexadien-1,4-ylene).

Includes Other Forms

Unless otherwise specified, included in the above are the well known ionic, salt, solvate, and protected forms of these substituents. For example, a reference to carboxylic acid (—COOH) also includes the anionic (carboxylate) form (—COO$^-$), a salt or solvate thereof, as well as conventional protected forms. Similarly, a reference to an amino group includes the protonated form (—N$^+$HR$^1$R$^2$), a salt or solvate of the amino group, for example, a hydrochloride salt, as well as conventional protected forms of an amino group. Similarly, a reference to a hydroxyl group also includes the anionic form (—O$^-$), a salt or solvate thereof, as well as conventional protected forms.

Salts

It may be convenient or desirable to prepare, purify, and/or handle a corresponding salt of the active compound, for example, a pharmaceutically-acceptable salt. Examples of pharmaceutically acceptable salts are discussed in Berge, et al., *J. Pharm. Sci.*, 66, 1-19 (1977).

For example, if the compound is anionic, or has a functional group which may be anionic (e.g. —COOH may be —COO⁻), then a salt may be formed with a suitable cation. Examples of suitable inorganic cations include, but are not limited to, alkali metal ions such as Na⁺ and K⁺, alkaline earth cations such as Ca²⁺ and Mg²⁺, and other cations such as Al⁺³. Examples of suitable organic cations include, but are not limited to, ammonium ion (i.e. $NH_4^+$) and substituted ammonium ions (e.g. $NH_3R^+$, $NH_2R_2^+$, $NHR_3^+$, $NR_4^+$). Examples of some suitable substituted ammonium ions are those derived from: ethylamine, diethylamine, dicyclohexylamine, triethylamine, butylamine, ethylenediamine, ethanolamine, diethanolamine, piperazine, benzylamine, phenylbenzylamine, choline, meglumine, and tromethamine, as well as amino acids, such as lysine and arginine. An example of a common quaternary ammonium ion is $N(CH_3)_4^+$.

If the compound is cationic, or has a functional group which may be cationic (e.g. —NH₂ may be —NH₃⁺), then a salt may be formed with a suitable anion. Examples of suitable inorganic anions include, but are not limited to, those derived from the following inorganic acids: hydrochloric, hydrobromic, hydroiodic, sulfuric, sulfurous, nitric, nitrous, phosphoric, and phosphorous.

Examples of suitable organic anions include, but are not limited to, those derived from the following organic acids: 2-acetyoxybenzoic, acetic, ascorbic, aspartic, benzoic, camphorsulfonic, cinnamic, citric, edetic, ethanedisulfonic, ethanesulfonic, fumaric, glucheptonic, gluconic, glutamic, glycolic, hydroxymaleic, hydroxynaphthalene carboxylic, isethionic, lactic, lactobionic, lauric, maleic, malic, methanesulfonic, mucic, oleic, oxalic, palmitic, pamoic, pantothenic, phenylacetic, phenylsulfonic, propionic, pyruvic, salicylic, stearic, succinic, sulfanilic, tartaric, toluenesulfonic, trifluoroacetic acid and valeric. Examples of suitable polymeric organic anions include, but are not limited to, those derived from the following polymeric acids: tannic acid, carboxymethyl cellulose.

Solvates

It may be convenient or desirable to prepare, purify, and/or handle a corresponding solvate of the active compound. The term "solvate" is used herein in the conventional sense to refer to a complex of solute (e.g. active compound, salt of active compound) and solvent. If the solvent is water, the solvate may be conveniently referred to as a hydrate, for example, a mono-hydrate, a di-hydrate, a tri-hydrate, etc.

The invention includes compounds where a solvent adds across the imine bond of the PBD moiety, which is illustrated below where the solvent is water or an alcohol ($R^4OH$, where $R^4$ is $C_{1-4}$ alkyl):

These particular compounds may be isolated in solid form, for example, by lyophilisation.

Isomers

Certain compounds of the invention may exist in one or more particular geometric, optical, enantiomeric, diastereomeric, epimeric, atropic, stereoisomeric, tautomeric, conformational, or anomeric forms, including but not limited to, cis- and trans-forms; E- and Z-forms; c-, t-, and r-forms; endo- and exo-forms; R-, S-, and meso-forms; D- and L-forms; d- and l-forms; (+) and (−) forms; keto-, enol-, and enolate-forms; syn- and anti-forms; synclinal- and anticlinal-forms; α- and β-forms; axial and equatorial forms; boat-, chair-, twist-, envelope-, and halfchair-forms; and combinations thereof, hereinafter collectively referred to as "isomers" (or "isomeric forms").

The term "chiral" refers to molecules which have the property of non-superimposability of the mirror image partner, while the term "achiral" refers to molecules which are superimposable on their mirror image partner.

The term "stereoisomers" refers to compounds which have identical chemical constitution, but differ with regard to the arrangement of the atoms or groups in space.

"Diastereomer" refers to a stereoisomer with two or more centers of chirality and whose molecules are not mirror images of one another. Diastereomers have different physical properties, e.g. melting points, boiling points, spectral properties, and reactivities. Mixtures of diastereomers may separate under high resolution analytical procedures such as electrophoresis and chromatography.

"Enantiomers" refer to two stereoisomers of a compound which are non-superimposable mirror images of one another.

Stereochemical definitions and conventions used herein generally follow S. P. Parker, Ed., *McGraw-Hill Dictionary of Chemical Terms* (1984) McGraw-Hill Book Company, New York; and Eliel, E. and Wilen, S., "Stereochemistry of Organic Compounds", John Wiley & Sons, Inc., New York, 1994. The compounds of the invention may contain asymmetric or chiral centers, and therefore exist in different stereoisomeric forms. It is intended that all stereoisomeric forms of the compounds of the invention, including but not limited to, diastereomers, enantiomers and atropisomers, as well as mixtures thereof such as racemic mixtures, form part of the present invention. Many organic compounds exist in optically active forms, i.e., they have the ability to rotate the plane of plane-polarized light. In describing an optically active compound, the prefixes D and L, or R and S, are used to denote the absolute configuration of the molecule about its chiral center(s). The prefixes d and l or (+) and (−) are employed to designate the sign of rotation of plane-polarized light by the compound, with (−) or l meaning that the

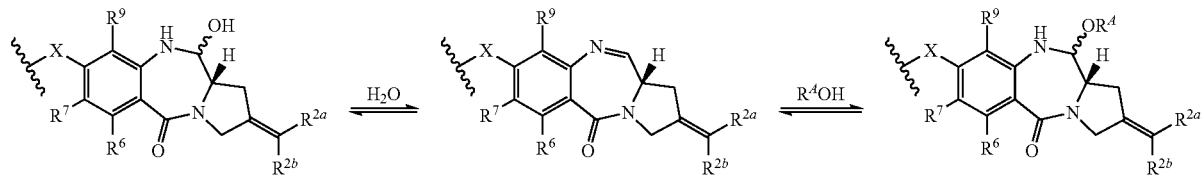

These forms can be called the carbinolamine and carbinolamine ether forms of the PBD (as described in the section relating to $R^{10}$ above). The balance of these equilibria depend on the conditions in which the compounds are found, as well as the nature of the moiety itself.

compound is levorotatory. A compound prefixed with (+) or d is dextrorotatory. For a given chemical structure, these stereoisomers are identical except that they are mirror images of one another. A specific stereoisomer may also be referred to as an enantiomer, and a mixture of such isomers is often called an enantiomeric mixture. A 50:50 mixture of enantiomers is referred to as a racemic mixture or a racemate, which may occur where there has been no stereoselection or stereospecificity in a chemical reaction or process. The terms "racemic mixture" and "racemate" refer to an equimolar mixture of two enantiomeric species, devoid of optical activity.

Note that, except as discussed below for tautomeric forms, specifically excluded from the term "isomers", as used herein, are structural (or constitutional) isomers (i.e. isomers which differ in the connections between atoms rather than merely by the position of atoms in space). For example, a reference to a methoxy group, —OCH$_3$, is not to be construed as a reference to its structural isomer, a hydroxymethyl group, —CH$_2$OH. Similarly, a reference to ortho-chlorophenyl is not to be construed as a reference to its structural isomer, meta-chlorophenyl. However, a reference to a class of structures may well include structurally isomeric forms falling within that class (e.g. $C_{1-7}$ alkyl includes n-propyl and iso-propyl; butyl includes n-, iso-, sec-, and tert-butyl; methoxyphenyl includes ortho-, meta-, and para-methoxyphenyl).

The above exclusion does not pertain to tautomeric forms, for example, keto-, enol-, and enolate-forms, as in, for example, the following tautomeric pairs: keto/enol (illustrated below), imine/enamine, amide/imino alcohol, amidine/amidine, nitroso/oxime, thioketone/enethiol, N-nitroso/hyroxyazo, and nitro/aci-nitro.

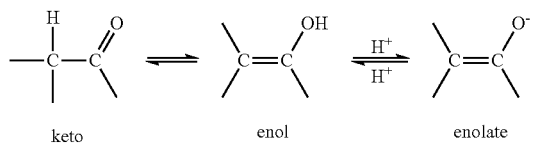

keto    enol    enolate

The term "tautomer" or "tautomeric form" refers to structural isomers of different energies which are interconvertible via a low energy barrier. For example, proton tautomers (also known as prototropic tautomers) include interconversions via migration of a proton, such as keto-enol and imine-enamine isomerizations. Valence tautomers include interconversions by reorganization of some of the bonding electrons.

Note that specifically included in the term "isomer" are compounds with one or more isotopic substitutions. For example, H may be in any isotopic form, including $^1H$, $^2H$ (D), and $^3H$ (T); C may be in any isotopic form, including $^{12}C$, $^{13}C$, and $^{14}C$; O may be in any isotopic form, including $^{16}O$ and $^{18}O$; and the like.

Examples of isotopes that can be incorporated into compounds of the invention include isotopes of hydrogen, carbon, nitrogen, oxygen, phosphorous, fluorine, and chlorine, such as, but not limited to $^2H$ (deuterium, D), $^3H$ (tritium), $^{11}C$, $^{13}C$ $^{14}C$, $^{15}N$, $^{18}F$, $^{31}P$, $^{32}P$, $^{35}S$, $^{36}Cl$, and $^{125}I$. Various isotopically labeled compounds of the present invention, for example those into which radioactive isotopes such as 3H, 13C, and 14C are incorporated. Such isotopically labelled compounds may be useful in metabolic studies, reaction kinetic studies, detection or imaging techniques, such as positron emission tomography (PET) or single-photon emission computed tomography (SPECT) including drug or substrate tissue distribution assays, or in radioactive treatment of patients. Deuterium labelled or substituted therapeutic compounds of the invention may have improved DMPK (drug metabolism and pharmacokinetics) properties, relating to distribution, metabolism, and excretion (ADME). Substitution with heavier isotopes such as deuterium may afford certain therapeutic advantages resulting from greater metabolic stability, for example increased in vivo half-life or reduced dosage requirements. An 18F labeled compound may be useful for PET or SPECT studies. Isotopically labeled compounds of this invention and prodrugs thereof can generally be prepared by carrying out the procedures disclosed in the schemes or in the examples and preparations described below by substituting a readily available isotopically labeled reagent for a non-isotopically labeled reagent. Further, substitution with heavier isotopes, particularly deuterium (i.e., 2H or D) may afford certain therapeutic advantages resulting from greater metabolic stability, for example increased in vivo half-life or reduced dosage requirements or an improvement in therapeutic index. It is understood that deuterium in this context is regarded as a substituent. The concentration of such a heavier isotope, specifically deuterium, may be defined by an isotopic enrichment factor. In the compounds of this invention any atom not specifically designated as a particular isotope is meant to represent any stable isotope of that atom.

Unless otherwise specified, a reference to a particular compound includes all such isomeric forms, including (wholly or partially) racemic and other mixtures thereof. Methods for the preparation (e.g. asymmetric synthesis) and separation (e.g. fractional crystallisation and chromatographic means) of such isomeric forms are either known in the art or are readily obtained by adapting the methods taught herein, or known methods, in a known manner.

Biological Activity

In Vitro Cell Proliferation Assays

Generally, the cytotoxic or cytostatic activity of an antibody-drug conjugate (ADC) is measured by: exposing mammalian cells having receptor proteins, e.g. HER2, to the antibody of the ADC in a cell culture medium; culturing the cells for a period from about 6 hours to about 5 days; and measuring cell viability. Cell-based in vitro assays are used to measure viability (proliferation), cytotoxicity, and induction of apoptosis (caspase activation) of an ADC of the invention.

The in vitro potency of antibody-drug conjugates can be measured by a cell proliferation assay. The CellTiter-Glo® Luminescent Cell Viability Assay is a commercially available (Promega Corp., Madison, Wis.), homogeneous assay method based on the recombinant expression of Coleoptera luciferase (U.S. Pat. Nos. 5,583,024; 5,674,713 and 5,700,670). This cell proliferation assay determines the number of viable cells in culture based on quantitation of the ATP present, an indicator of metabolically active cells (Crouch et al (1993) J. Immunol. Meth. 160:81-88; U.S. Pat. No. 6,602,677). The CellTiter-Glo® Assay is conducted in 96 well format, making it amenable to automated high-throughput screening (HTS) (Cree et al (1995) AntiCancer Drugs 6:398-404). The homogeneous assay procedure involves adding the single reagent (CellTiter-Glo® Reagent) directly to cells cultured in serum-supplemented medium. Cell washing, removal of medium and multiple pipetting steps are not required. The system detects as few as 15 cells/well in a 384-well format in 10 minutes after adding reagent and mixing. The cells may be treated continuously with ADC, or they may be treated and separated from ADC. Generally, cells treated briefly, i.e. 3 hours, showed the same potency effects as continuously treated cells.

The homogeneous "add-mix-measure" format results in cell lysis and generation of a luminescent signal proportional to the amount of ATP present. The amount of ATP is directly proportional to the number of cells present in culture. The CellTiter-Glo® Assay generates a "glow-type" luminescent signal, produced by the luciferase reaction, which has a half-life generally greater than five hours, depending on cell type and medium used. Viable cells are reflected in relative luminescence units (RLU). The substrate, Beetle Luciferin, is oxidatively decarboxylated by recombinant firefly luciferase with concomitant conversion of ATP to AMP and generation of photons.

The in vitro potency of antibody-drug conjugates can also be measured by a cytotoxicity assay. Cultured adherent cells are washed with PBS, detached with trypsin, diluted in complete medium, containing 10% FCS, centrifuged, resuspended in fresh medium and counted with a haemocytometer. Suspension cultures are counted directly. Monodisperse cell suspensions suitable for counting may require agitation of the suspension by repeated aspiration to break up cell clumps.

The cell suspension is diluted to the desired seeding density and dispensed (100 µl per well) into black 96 well plates. Plates of adherent cell lines are incubated overnight to allow adherence. Suspension cell cultures can be used on the day of seeding.

A stock solution (1 ml) of ADC (20 µg/ml) is made in the appropriate cell culture medium. Serial 10-fold dilutions of stock ADC are made in 15 ml centrifuge tubes by serially transferring 100 µl to 900 µl of cell culture medium.

Four replicate wells of each ADC dilution (100 µl) are dispensed in 96-well black plates, previously plated with cell suspension (100 µl), resulting in a final volume of 200 µl. Control wells receive cell culture medium (100 µl).

If the doubling time of the cell line is greater than 30 hours, ADC incubation is for 5 days, otherwise a four day incubation is done.

At the end of the incubation period, cell viability is assessed with the Alamar blue assay. AlamarBlue (Invitrogen) is dispensed over the whole plate (20 µl per well) and incubated for 4 hours. Alamar blue fluorescence is measured at excitation 570 nm, emission 585 nm on the Varioskan flash plate reader. Percentage cell survival is calculated from the mean fluorescence in the ADC treated wells compared to the mean fluorescence in the control wells.

In Vivo Efficacy

The in vivo efficacy of antibody-drug conjugates (ADC) of the invention can be measured by tumor xenograft studies in mice. For example, the in vivo efficacy of an anti-HER2 ADC of the invention can be measured by a high expressing HER2 transgenic explant mouse model. An allograft is propagated from the Fo5 mmtv transgenic mouse which does not respond to, or responds poorly to, HERCEPTIN® therapy. Subjects were treated once with ADC at certain dose levels (mg/kg) and PBD drug exposure (µg/m$^2$); and placebo buffer control (Vehicle) and monitored over two weeks or more to measure the time to tumor doubling, log cell kill, and tumor shrinkage.

Use

The conjugates of the invention may be used to provide a PBD conjugate at a target location.

The target location is preferably a proliferative cell population. The antibody is an antibody for an antigen present in a proliferative cell population.

In one embodiment the antigen is absent or present at a reduced level in a non-proliferative cell population compared to the amount of antigen present in the proliferative cell population, for example a tumour cell population.

The target location may be in vitro, in vivo or ex vivo.

The antibody-drug conjugate (ADC) compounds of the invention include those with utility for anticancer activity. In particular, the compounds include an antibody conjugated, i.e. covalently attached by a linker, to a PBD moiety. At the target location the linker may be cleaved. The antibody-drug conjugate (ADC compounds of the invention may have a cytotoxic effect with the cleavage of the linker to release a PBD drug moiety. The antibody-drug conjugates (ADC) of the invention selectively deliver cytotoxic agent to tumor tissue whereby greater selectivity, i.e. a lower efficacious dose, may be achieved.

Thus, in one aspect, the present invention provides a conjugate compound as described herein for use in therapy.

In a further aspect there is also provides a conjugate compound as described herein for use in the treatment of a proliferative disease. A second aspect of the present invention provides the use of a conjugate compound in the manufacture of a medicament for treating a proliferative disease.

One of ordinary skill in the art is readily able to determine whether or not a candidate conjugate treats a proliferative condition for any particular cell type. For example, assays which may conveniently be used to assess the activity offered by a particular compound are described in the examples below.

The term "proliferative disease" pertains to an unwanted or uncontrolled cellular proliferation of excessive or abnormal cells which is undesired, such as, neoplastic or hyperplastic growth, whether in vitro or in vivo.

Examples of proliferative conditions include, but are not limited to, benign, pre-malignant, and malignant cellular proliferation, including but not limited to, neoplasms and tumours (e.g. histocytoma, glioma, astrocyoma, osteoma), cancers (e.g. lung cancer, small cell lung cancer, gastrointestinal cancer, bowel cancer, colon cancer, breast carinoma, ovarian carcinoma, prostate cancer, testicular cancer, liver cancer, kidney cancer, bladder cancer, pancreas cancer, brain cancer, sarcoma, osteosarcoma, Kaposi's sarcoma, melanoma), leukemias, psoriasis, bone diseases, fibroproliferative disorders (e.g. of connective tissues), and atherosclerosis. Cancers of particular interest include, but are not limited to, leukemias and ovarian cancers.

Any type of cell may be treated, including but not limited to, lung, gastrointestinal (including, e.g. bowel, colon), breast (mammary), ovarian, prostate, liver (hepatic), kidney (renal), bladder, pancreas, brain, and skin.

In one embodiment, the treatment is of a pancreatic cancer.

In one embodiment, the treatment is of a tumour having $\alpha_v\beta_6$ integrin on the surface of the cell.

It is contemplated that the antibody-drug conjugates (ADC) of the present invention may be used to treat various diseases or disorders, e.g. characterized by the overexpression of a tumor antigen. Exemplary conditions or hyperproliferative disorders include benign or malignant tumors; leukemia, haematological, and lymphoid malignancies. Others include neuronal, glial, astrocytal, hypothalamic, glandular, macrophagal, epithelial, stromal, blastocoelic, inflammatory, angiogenic and immunologic, including autoimmune, disorders.

Generally, the disease or disorder to be treated is a hyperproliferative disease such as cancer. Examples of cancer to be treated herein include, but are not limited to, carcinoma, lymphoma, blastoma, sarcoma, and leukemia or lymphoid malignancies. More particular examples of such cancers include squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, as well as head and neck cancer.

Autoimmune diseases for which the ADC compounds may be used in treatment include rheumatologic disorders (such as, for example, rheumatoid arthritis, Sjögren's syndrome, scleroderma, lupus such as SLE and lupus nephritis, polymyositis/dermatomyositis, cryoglobulinemia, antiphospholipid antibody syndrome, and psoriatic arthritis), osteoarthritis, autoimmune gastrointestinal and liver disorders (such as, for example, inflammatory bowel diseases (e.g. ulcerative colitis and Crohn's disease), autoimmune gastritis and pernicious anemia, autoimmune hepatitis, primary biliary cirrhosis, primary sclerosing cholangitis, and celiac disease), vasculitis (such as, for example, ANCA-associated vasculitis, including Churg-Strauss vasculitis, Wegener's granulomatosis, and polyarteriitis), autoimmune neurological disorders (such as, for example, multiple sclerosis, opsoclonus myoclonus syndrome, myasthenia gravis, neuromyelitis optica, Parkinson's disease, Alzheimer's disease, and autoimmune polyneuropathies), renal disorders (such as, for example, glomerulonephritis, Goodpasture's syndrome, and Berger's disease), autoimmune dermatologic disorders (such as, for example, psoriasis, urticaria, hives, pemphigus vulgaris, bullous pemphigoid, and cutaneous lupus erythematosus), hematologic disorders (such as, for example, thrombocytopenic purpura, thrombotic thrombocytopenic purpura, post-transfusion purpura, and autoimmune hemolytic anemia), atherosclerosis, uveitis, autoimmune hearing diseases (such as, for example, inner ear disease and hearing loss), Behcet's disease, Raynaud's syndrome, organ transplant, and autoimmune endocrine disorders (such as, for example, diabetic-related autoimmune diseases such as insulin-dependent diabetes mellitus (IDDM), Addison's disease, and autoimmune thyroid disease (e.g. Graves' disease and thyroiditis)). More preferred such diseases include, for example, rheumatoid arthritis, ulcerative colitis, ANCA-associated vasculitis, lupus, multiple sclerosis, Sjögren's syndrome, Graves' disease, IDDM, pernicious anemia, thyroiditis, and glomerulonephritis.

Methods of Treatment

The conjugates of the present invention may be used in a method of therapy. Also provided is a method of treatment, comprising administering to a subject in need of treatment a therapeutically-effective amount of a conjugate compound of the invention. The term "therapeutically effective amount" is an amount sufficient to show benefit to a patient. Such benefit may be at least amelioration of at least one symptom. The actual amount administered, and rate and time-course of administration, will depend on the nature and severity of what is being treated. Prescription of treatment, e.g. decisions on dosage, is within the responsibility of general practitioners and other medical doctors.

A compound of the invention may be administered alone or in combination with other treatments, either simultaneously or sequentially dependent upon the condition to be treated. Examples of treatments and therapies include, but are not limited to, chemotherapy (the administration of active agents, including, e.g. drugs, such as chemotherapeutics); surgery; and radiation therapy.

A "chemotherapeutic agent" is a chemical compound useful in the treatment of cancer, regardless of mechanism of action. Classes of chemotherapeutic agents include, but are not limited to: alkylating agents, antimetabolites, spindle poison plant alkaloids, cytotoxic/antitumor antibiotics, topoisomerase inhibitors, antibodies, photosensitizers, and kinase inhibitors. Chemotherapeutic agents include compounds used in "targeted therapy" and conventional chemotherapy.

Examples of chemotherapeutic agents include: erlotinib (TARCEVA®, Genentech/OSI Pharm.), docetaxel (TAXOTERE®, Sanofi-Aventis), 5-FU (fluorouracil, 5-fluorouracil, CAS No. 51-21-8), gemcitabine (GEMZAR®, Lilly), PD-0325901 (CAS No. 391210-10-9, Pfizer), cisplatin (cis-diamine, dichloroplatinum(II), CAS No. 15663-27-1), carboplatin (CAS No. 41575-94-4), paclitaxel (TAXOL®, Bristol-Myers Squibb Oncology, Princeton, N.J.), trastuzumab (HERCEPTIN®, Genentech), temozolomide (4-methyl-5-oxo-2,3,4,6,8-pentazabicyclo [4.3.0] nona-2,7,9-triene-9-carboxamide, CAS No. 85622-93-1, TEMODAR®, TEMODAL®, Schering Plough), tamoxifen ((Z)-2-[4-(1,2-diphenylbut-1-enyl)phenoxy]-N,N-dimethylethanamine, NOLVADEX®, ISTUBAL®, VALODEX®), and doxorubicin (ADRIAMYCIN®), Akti-1/2, HPPD, and rapamycin.

More examples of chemotherapeutic agents include: oxaliplatin (ELOXATIN®, Sanofi), bortezomib (VELCADE®, Millennium Pharm.), sutent (SUNITINIB®, SU11248, Pfizer), letrozole (FEMARA®, Novartis), imatinib mesylate (GLEEVEC®, Novartis), XL-518 (Mek inhibitor, Exelixis, WO 2007/044515), ARRY-886 (Mek inhibitor, AZD6244, Array BioPharma, Astra Zeneca), SF-1126 (PI3K inhibitor, Semafore Pharmaceuticals), BEZ-235 (PI3K inhibitor, Novartis), XL-147 (PI3K inhibitor, Exelixis), PTK787/ZK 222584 (Novartis), fulvestrant (FASLODEX®, AstraZeneca), leucovorin (folinic acid), rapamycin (sirolimus, RAPAMUNE®, Wyeth), lapatinib (TYKERB®, GSK572016, Glaxo Smith Kline), lonafarnib (SARASAR™, SCH 66336, Schering Plough), sorafenib (NEXAVAR®, BAY43-9006, Bayer Labs), gefitinib (IRESSA®, AstraZeneca), irinotecan (CAMPTOSAR®, CPT-11, Pfizer), tipifarnib (ZARNESTRA™, Johnson & Johnson), ABRAXANE™ (Cremophor-free), albumin-engineered nanoparticle formulations of paclitaxel (American Pharmaceutical Partners, Schaumberg, Il), vandetanib (rINN, ZD6474, ZACTIMA®, AstraZeneca), chloranmbucil, AG1478, AG1571 (SU 5271; Sugen), temsirolimus (TORISEL®, Wyeth), pazopanib (GlaxoSmithKline), canfosfamide (TELCYTA®, Telik), thiotepa and cyclosphosphamide (CYTOXAN®, NEOSAR®); alkyl sulfonates such as busulfan, improsulfan and piposulfan; aziridines such as benzodopa, carboquone, meturedopa, and uredopa; ethylenimines and methylamelamines including altretamine, triethylenemelamine, triethylenephosphoramide, triethylenethiophosphoramide and trimethylomelamine; acetogenins (especially bullatacin and bullatacinone); a camptothecin (including the synthetic analog topotecan); bryostatin; callystatin; CC-1065 (including its adozelesin, carzelesin and bizelesin synthetic analogs); cryptophycins (particularly cryptophycin 1 and cryptophycin 8); dolastatin; duocarmycin (including the synthetic analogs, KW-2189 and CB1-TM1); eleutherobin; pancratistatin; a sarcodictyin; spongistatin; nitrogen mustards such as chlorambucil, chlornaphazine, chlorophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimnustine; antibiotics such as the enediyne antibiotics (e.g. calicheamicin, calicheamicin gammall, calicheamicin omegall (*Angew Chem. Intl. Ed. Engl.* (1994) 33:183-186); dynemicin, dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, morpholino-doxorubicin, cyanomorpholino-doxorubicin, 2-pyrrolino-doxorubicin and deoxydoxorubicin), epirubicin, esorubicin, idarubicin, nemorubicin, marcellomycin, mitomycins such as mitomycin C, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogs such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; 6-thioguanine; mercaptopurine; methotrexate; platinum analogs such as cisplatin and carboplatin; vinblastine; etoposide (VP-16); ifosfamide; mitoxantrone; vincristine; vinorelbine (NAVELBINE®); novantrone; teniposide; edatrexate; daunomycin; aminopterin; capecitabine (XELODA®, Roche); ibandronate; CPT-11; topoisomerase inhibitor RFS 2000; difluoromethylornithine (DMFO); retinoids such as retinoic acid; and pharmaceutically acceptable salts, acids and derivatives of any of the above.

Also included in the definition of "chemotherapeutic agent" are: (i) anti-hormonal agents that act to regulate or inhibit hormone action on tumors such as anti-estrogens and selective estrogen receptor modulators (SERMs), including, for example, tamoxifen (including NOLVADEX®; tamoxifen citrate), raloxifene, droloxifene, 4-hydroxytamoxifen, trioxifene, keoxifene, LY117018, onapristone, and FARESTON® (toremifine citrate); (ii) aromatase inhibitors that inhibit the enzyme aromatase, which regulates estrogen production in the adrenal glands, such as, for example, 4(5)-imidazoles, aminoglutethimide, MEGASE® (megestrol acetate), AROMASIN® (exemestane; Pfizer), formestanie, fadrozole, RIVISOR® (vorozole), FEMARA® (letrozole; Novartis), and ARIMIDEX® (anastrozole; AstraZeneca); (iii) anti-androgens such as flutamide, nilutamide, bicalutamide, leuprolide, and goserelin; as well as troxacitabine (a 1,3-dioxolane nucleoside cytosine analog); (iv) protein kinase inhibitors such as MEK inhibitors (WO 2007/044515); (v) lipid kinase inhibitors; (vi) antisense oligonucleotides, particularly those which inhibit expression of genes in signaling pathways implicated in aberrant cell proliferation, for example, PKC-alpha, Raf and H-Ras, such as oblimersen (GENASENSE®, Genta Inc.); (vii) ribozymes such as VEGF expression inhibitors (e.g., ANGIOZYME®) and HER2 expression inhibitors; (viii) vaccines such as gene therapy vaccines, for example, ALLOVECTIN®, LEUVECTIN®, and VAXID®; PROLEUKIN® rIL-2; topoisomerase 1 inhibitors such as LURTOTECAN®; ABARELIX® rmRH; (ix) anti-angiogenic agents such as bevacizumab (AVASTIN®, Genentech); and pharmaceutically acceptable salts, acids and derivatives of any of the above.

Also included in the definition of "chemotherapeutic agent" are therapeutic antibodies such as alemtuzumab (Campath), bevacizumab (AVASTIN®, Genentech); cetuximab (ERBITUX®, Imclone); panitumumab (VECTIBIX®, Amgen), rituximab (RITUXAN®, Genentech/Biogen Idec), pertuzumab (OMNITARG™, 2C4, Genentech), trastuzumab (HERCEPTIN®, Genentech), tositumomab (Bexxar, Corixia), and the antibody drug conjugate, gemtuzumab ozogamicin (MYLOTARG®, Wyeth).

Humanized monoclonal antibodies with therapeutic potential as chemotherapeutic agents in combination with the conjugates of the invention include: alemtuzumab, apolizumab, aselizumab, atlizumab, bapineuzumab, bevacizumab, bivatuzumab mertansine, cantuzumab mertansine, cedelizumab, certolizumab pegol, cidfusituzumab, cidtuzumab, daclizumab, eculizumab, efalizumab, epratuzumab, erlizumab, felvizumab, fontolizumab, gemtuzumab ozogamicin, inotuzumab ozogamicin, ipilimumab, labetuzumab, lintuzumab, matuzumab, mepolizumab, motavizumab, motovizumab, natalizumab, nimotuzumab, nolovizumab, numavizumab, ocrelizumab, omalizumab, palivizumab, pascolizumab, pecfusituzumab, pectuzumab, pertuzumab, pexelizumab, ralivizumab, ranibizumab, reslivizumab, reslizumab, resyvizumab, rovelizumab, ruplizumab, sibrotuzumab, siplizumab, sontuzumab, tacatuzumab tetraxetan, tadocizumab, talizumab, tefibazumab, tocilizumab, toralizumab, trastuzumab, tucotuzumab celmoleukin, tucusituzumab, umavizumab, urtoxazumab, and visilizumab.

Pharmaceutical compositions according to the present invention, and for use in accordance with the present invention, may comprise, in addition to the active ingredient, i.e. a conjugate compound, a pharmaceutically acceptable excipient, carrier, buffer, stabiliser or other materials well known to those skilled in the art. Such materials should be non-toxic and should not interfere with the efficacy of the active ingredient. The precise nature of the carrier or other material will depend on the route of administration, which may be oral, or by injection, e.g. cutaneous, subcutaneous, or intravenous.

Pharmaceutical compositions for oral administration may be in tablet, capsule, powder or liquid form. A tablet may comprise a solid carrier or an adjuvant. Liquid pharmaceutical compositions generally comprise a liquid carrier such as water, petroleum, animal or vegetable oils, mineral oil or synthetic oil. Physiological saline solution, dextrose or other saccharide solution or glycols such as ethylene glycol, propylene glycol or polyethylene glycol may be included. A capsule may comprise a solid carrier such a gelatin.

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilisers, buffers, antioxidants and/or other additives may be included, as required.

Formulations

While it is possible for the conjugate compound to be used (e.g., administered) alone, it is often preferable to present it as a composition or formulation.

In one embodiment, the composition is a pharmaceutical composition (e.g., formulation, preparation, medicament) comprising a conjugate compound, as described herein, and a pharmaceutically acceptable carrier, diluent, or excipient.

In one embodiment, the composition is a pharmaceutical composition comprising at least one conjugate compound, as described herein, together with one or more other pharmaceutically acceptable ingredients well known to those skilled in the art, including, but not limited to, pharmaceutically acceptable carriers, diluents, excipients, adjuvants, fillers, buffers, preservatives, anti-oxidants, lubricants, stabilisers, solubilisers, surfactants (e.g., wetting agents), masking agents, colouring agents, flavouring agents, and sweetening agents.

In one embodiment, the composition further comprises other active agents, for example, other therapeutic or prophylactic agents.

Suitable carriers, diluents, excipients, etc. can be found in standard pharmaceutical texts. See, for example, *Handbook of Pharmaceutical Additives*, 2nd Edition (eds. M. Ash and I. Ash), 2001 (Synapse Information Resources, Inc., Endicott, N.Y., USA), *Remington's Pharmaceutical Sciences*, 20th edition, pub. Lippincott, Williams & Wilkins, 2000; and *Handbook of Pharmaceutical Excipients*, 2nd edition, 1994.

Another aspect of the present invention pertains to methods of making a pharmaceutical composition comprising admixing at least one [$^{11}$C]-radiolabelled conjugate or conjugate-like compound, as defined herein, together with one or more other pharmaceutically acceptable ingredients well known to those skilled in the art, e.g., carriers, diluents, excipients, etc. If formulated as discrete units (e.g., tablets, etc.), each unit contains a predetermined amount (dosage) of the active compound.

The term "pharmaceutically acceptable," as used herein, pertains to compounds, ingredients, materials, compositions, dosage forms, etc., which are, within the scope of sound medical judgment, suitable for use in contact with the tissues of the subject in question (e.g., human) without excessive toxicity, irritation, allergic response, or other problem or complication, commensurate with a reasonable benefit/risk ratio. Each carrier, diluent, excipient, etc. must also be "acceptable" in the sense of being compatible with the other ingredients of the formulation.

The formulations may be prepared by any methods well known in the art of pharmacy. Such methods include the step of bringing into association the active compound with a carrier which constitutes one or more accessory ingredients. In general, the formulations are prepared by uniformly and intimately bringing into association the active compound with carriers (e.g., liquid carriers, finely divided solid carrier, etc.), and then shaping the product, if necessary.

The formulation may be prepared to provide for rapid or slow release; immediate, delayed, timed, or sustained release; or a combination thereof.

Formulations suitable for parenteral administration (e.g., by injection), include aqueous or non-aqueous, isotonic, pyrogen-free, sterile liquids (e.g., solutions, suspensions), in which the active ingredient is dissolved, suspended, or otherwise provided (e.g., in a liposome or other microparticulate). Such liquids may additional contain other pharmaceutically acceptable ingredients, such as anti-oxidants, buffers, preservatives, stabilisers, bacteriostats, suspending agents, thickening agents, and solutes which render the formulation isotonic with the blood (or other relevant bodily fluid) of the intended recipient. Examples of excipients include, for example, water, alcohols, polyols, glycerol, vegetable oils, and the like. Examples of suitable isotonic carriers for use in such formulations include Sodium Chloride Injection, Ringer's Solution, or Lactated Ringer's Injection. Typically, the concentration of the active ingredient in the liquid is from about 1 ng/ml to about 10 µg/ml, for example from about 10 ng/ml to about 1 µg/ml. The formulations may be presented in unit-dose or multi-dose sealed containers, for example, ampoules and vials, and may be stored in a freeze-dried (lyophilised) condition requiring only the addition of the sterile liquid carrier, for example water for injections, immediately prior to use. Extemporaneous injection solutions and suspensions may be prepared from sterile powders, granules, and tablets.

Dosage

It will be appreciated by one of skill in the art that appropriate dosages of the conjugate compound, and compositions comprising the conjugate compound, can vary from patient to patient. Determining the optimal dosage will generally involve the balancing of the level of therapeutic benefit against any risk or deleterious side effects. The selected dosage level will depend on a variety of factors including, but not limited to, the activity of the particular compound, the route of administration, the time of administration, the rate of excretion of the compound, the duration of the treatment, other drugs, compounds, and/or materials used in combination, the severity of the condition, and the species, sex, age, weight, condition, general health, and prior medical history of the patient. The amount of compound and route of administration will ultimately be at the discretion of the physician, veterinarian, or clinician, although generally the dosage will be selected to achieve local concentrations at the site of action which achieve the desired effect without causing substantial harmful or deleterious side-effects.

Administration can be effected in one dose, continuously or intermittently (e.g., in divided doses at appropriate intervals) throughout the course of treatment. Methods of determining the most effective means and dosage of administration are well known to those of skill in the art and will vary with the formulation used for therapy, the purpose of the therapy, the target cell(s) being treated, and the subject being treated. Single or multiple administrations can be carried out with the dose level and pattern being selected by the treating physician, veterinarian, or clinician.

In general, a suitable dose of the active compound is in the range of about 100 ng to about 25 mg (more typically about 1 µg to about 10 mg) per kilogram body weight of the subject per day. Where the active compound is a salt, an ester, an amide, a prodrug, or the like, the amount administered is calculated on the basis of the parent compound and so the actual weight to be used is increased proportionately.

In one embodiment, the active compound is administered to a human patient according to the following dosage regime: about 100 mg, 3 times daily.

In one embodiment, the active compound is administered to a human patient according to the following dosage regime: about 150 mg, 2 times daily.

In one embodiment, the active compound is administered to a human patient according to the following dosage regime: about 200 mg, 2 times daily.

However in one embodiment, the conjugate compound is administered to a human patient according to the following dosage regime: about 50 or about 75 mg, 3 or 4 times daily.

In one embodiment, the conjugate compound is administered to a human patient according to the following dosage regime: about 100 or about 125 mg, 2 times daily.

The dosage amounts described above may apply to the conjugate (including the PBD moiety and the linker to the antibody) or to the effective amount of PBD compound provided, for example the amount of compound that is releasable after cleavage of the linker.

For the prevention or treatment of disease, the appropriate dosage of an ADC of the invention will depend on the type of disease to be treated, as defined above, the severity and course of the disease, whether the molecule is administered for preventive or therapeutic purposes, previous therapy, the patient's clinical history and response to the antibody, and the discretion of the attending physician. The molecule is suitably administered to the patient at one time or over a series of treatments. Depending on the type and severity of the disease, about 1 µg/kg to 15 mg/kg (e.g. 0.1-20 mg/kg) of molecule is an initial candidate dosage for administration to the patient, whether, for example, by one or more separate administrations, or by continuous infusion. A typical daily dosage might range from about 1 µg/kg to 100 mg/kg or more, depending on the factors mentioned above. An exemplary dosage of ADC to be administered to a patient is in the range of about 0.1 to about 10 mg/kg of patient weight. For repeated administrations over several days or longer, depending on the condition, the treatment is sustained until a desired suppression of disease symptoms occurs. An exemplary dosing regimen comprises a course of administering an initial loading dose of about 4 mg/kg, followed by additional doses every week, two weeks, or three weeks of an ADC. Other dosage regimens may be useful. The progress of this therapy is easily monitored by conventional techniques and assays.

Treatment

The term "treatment," as used herein in the context of treating a condition, pertains generally to treatment and therapy, whether of a human or an animal (e.g., in veterinary applications), in which some desired therapeutic effect is achieved, for example, the inhibition of the progress of the condition, and includes a reduction in the rate of progress, a halt in the rate of progress, regression of the condition, amelioration of the condition, and cure of the condition. Treatment as a prophylactic measure (i.e., prophylaxis, prevention) is also included.

The term "therapeutically-effective amount," as used herein, pertains to that amount of an active compound, or a material, composition or dosage from comprising an active compound, which is effective for producing some desired therapeutic effect, commensurate with a reasonable benefit/risk ratio, when administered in accordance with a desired treatment regimen.

Similarly, the term "prophylactically-effective amount," as used herein, pertains to that amount of an active compound, or a material, composition or dosage from comprising an active compound, which is effective for producing some desired prophylactic effect, commensurate with a reasonable benefit/risk ratio, when administered in accordance with a desired treatment regimen.

Preparation of Antibody Drug Conjugates

Antibody drug conjugates may be prepared by several routes, employing organic chemistry reactions, conditions, and reagents known to those skilled in the art, including: (1) reaction of a nucleophilic group of an antibody with a bivalent linker reagent, to form antibody-linker intermediate Ab-L, via a covalent bond, followed by reaction with an activated drug moiety reagent; and (2) reaction of a drug moiety reagent with a linker reagent, to form drug-linker reagent D-L, via a covalent bond, followed by reaction with the nucleophilic of an antibody. Conjugation methods (1) and (2) may be employed with a variety of antibodies, and linkers to prepare the antibody-drug conjugates of the invention.

Nucleophilic groups on antibodies include, but are not limited to side chain thiol groups, e.g. cysteine. Thiol groups are nucleophilic and capable of reacting to form covalent bonds with electrophilic groups on linker moieties such as those of the present invention. Certain antibodies have reducible interchain disulfides, i.e. cysteine bridges. Antibodies may be made reactive for conjugation with linker reagents by treatment with a reducing agent such as DTT (Cleland's reagent, dithiothreitol) or TCEP (tris(2-carboxyethyl)phosphine hydrochloride; Getz et al (1999) Anal. Biochem. Vol 273:73-80; Soltec Ventures, Beverly, Mass.). Each cysteine disulfide bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol.

The Subject/Patient

The subject/patient may be an animal, mammal, a placental mammal, a marsupial (e.g., kangaroo, wombat), a monotreme (e.g., duckbilled platypus), a rodent (e.g., a guinea pig, a hamster, a rat, a mouse), murine (e.g., a mouse), a lagomorph (e.g., a rabbit), avian (e.g., a bird), canine (e.g., a dog), feline (e.g., a cat), equine (e.g., a horse), porcine (e.g., a pig), ovine (e.g., a sheep), bovine (e.g., a cow), a primate, simian (e.g., a monkey or ape), a monkey (e.g., marmoset, baboon), an ape (e.g., gorilla, chimpanzee, orangutang, gibbon), or a human.

Furthermore, the subject/patient may be any of its forms of development, for example, a foetus. In one preferred embodiment, the subject/patient is a human. In one embodiment, the patient is a population where each patient has a tumour having $\alpha_v\beta_6$ integrin on the surface of the cell.

Synthesis

Conjugates of formula A may be synthesised from corresponding drug-linker compounds of formula B by reacting them with cell binding agents under appropriate conditions. Thus, conjugates where Y is of formula A1 may be synthesised from drug-linker compounds where $Y^L$ is of formula B1. Conjugates where Y is of formula A2 may be synthesised from drug-linker compounds where $Y^L$ is of formula B2.

The conditions, as described above, will depend on the type of bond being formed between the drug-linker compound and the cell binding agent, which itself will reflect the nature of the binding site on the cell binding agent.

Drug-linker compounds of formula B may be synthesised from corresponding compounds of formula C.

Drug-linker compounds where $Y^L$ is of formula B1 may be synthesised from compounds where $Y^C$ is of formula C1, by reaction with a compound of formula E1:

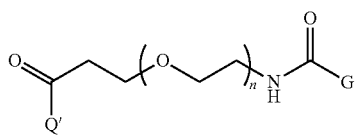

E1 in an appropriate solvent, where Q' is

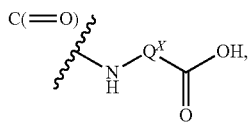

in the presence of an amide coupling reagent.

Drug-linker compounds where $Y^L$ is of formula B2 may be synthesised from compounds where $Y^C$ is of formula C2, by reaction with a compound of formula E1 in an appropriate solvent, in the presence of an amide coupling reagent.

Alternatively, the group formed by E1 may be added in two steps, adding compound F1 (or a protected version thereof) in an appropriate solvent, in the presence of an amide coupling reagent, followed by F2 in an appropriate solvent, in the presence of an amide coupling reagent. If a protected version of F1 is used, it will be deprotected before F2 is added.

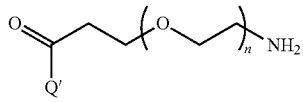

F1

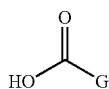

F2

Compound of formula C can be made from the corresponding compound of formula G:

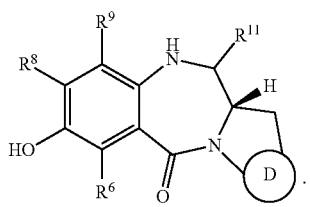

G

Compounds of formula C where $Y^C$ is of formula C1 may be synthesised by reacting a compound of formula G with a compound of formula H1:

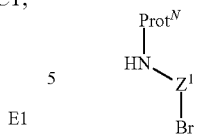

H1 where $Prot^N$ is an amine protecting group, such as Alloc, in the presence of tetrabutylammonium iodide and potassium carbonate, followed by deprotection of the amine under standard conditions. The protecting group used should be orthogonal to any other protecting groups in the compound.

Compounds of formula C where $Y^C$ is of formula C2 may be synthesised by reacting a compound of formula G with a compound of formula H2:

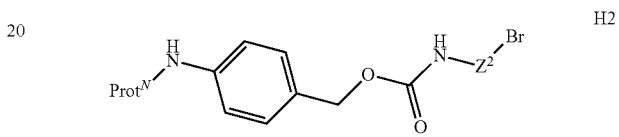

H2 where $Prot^N$ is an amine protecting group, such as Alloc, in the presence of tetrabutylammonium iodide and potassium carbonate, followed by deprotection of the amine under standard conditions. The protecting group used should be orthogonal to any other protecting groups in the compound.

Alternatively, compounds of formula C where $Y^C$ is of formula C2 may be synthesised by reacting a compound of formula G with a compound of formula H3:

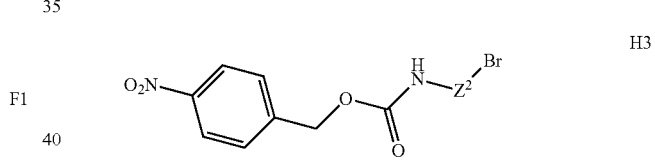

H3 in the presence of tetrabutylammonium iodide and potassium carbonate, followed by reduction of the nitro group under standard conditions.

Compound of formula G containing a single PBD moiety can be synthesised according to the disclosure of WO 2005/085259, and in particular the discussion from pages 31 to 39, which is incorporated herein be reference. Reference is also made to the teaching of co-pending application PCT/EP2012/070232, filed on 12 Oct. 2012.

The synthesis of PBD compounds containing two imine moieties is extensively discussed in the following references, which discussions are incorporated herein by reference:
a) WO 00/12508 (pages 14 to 30);
b) WO 2005/023814 (pages 3 to 10);
c) WO 2004/043963 (pages 28 to 29);
d) WO 2005/085251 (pages 30 to 39); and
e) WO 2011/130598 (pages 126 to 150).

The disclosure of WO 2005/085259 discussed above is also relevant to the synthesis of compounds of formula G which comprise two PBD moieties. The synthesis methods disclosed therein may be modified to include an orthogonally protected hydroxyl group at C7 (i.e. group $R^4$ in Scheme 4).

Alternatively, compounds of formula G may be synthesised as described in the above references, but starting from a dimer core of formula J:

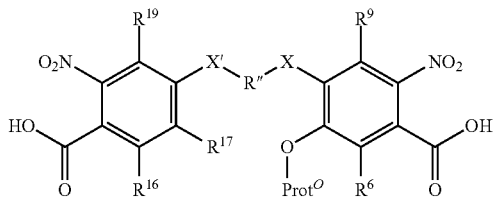

where $Prot^O$ is a hydroxyl protecting group. Such compounds of formula J may be made by methods analogous to those in the examples of the present application.

In other methods, compounds of K1 or K2:

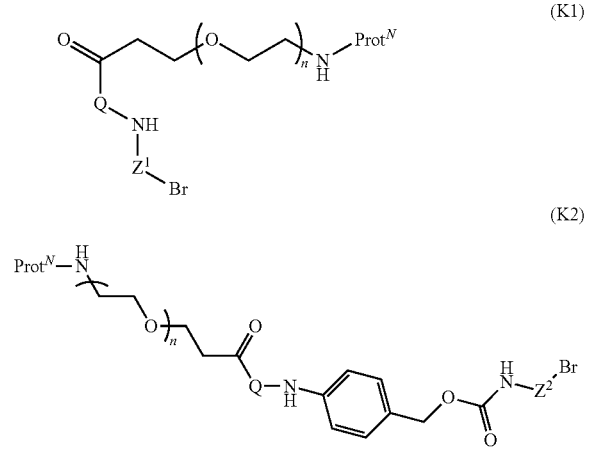

may be reacted with G, followed by conversion to drug linkers of formula B, by deprotection and addition of a compound of formula F2.

Amine Protecting Groups

Amine protecting groups are well-known to those skilled in the art. Particular reference is made to the disclosure of suitable protecting groups in Greene's Protecting Groups in Organic Synthesis, Fourth Edition, John Wiley & Sons, 2007 (ISBN 978-0-471-69754-1), pages 696-871.

Hydroxyl Protecting Groups

Hydroxyl protecting groups are well-known to those skilled in the art. Particular reference is made to the disclosure of suitable protecting groups in Greene's Protecting Groups in Organic Synthesis, Fourth Edition, John Wiley & Sons, 2007 (ISBN 978-0-471-69754-1), pages 16-298.

EXAMPLES

General Conditions

Reaction progress was monitored by thin-layer chromatography (TLC) using Merck Kieselgel 60 F254 silica gel, with fluorescent indicator on aluminium plates. Visualisation of TLC was achieved with UV light or iodine vapour unless otherwise stated. Flash chromatography was performed using Merck Kieselgel 60 F254 silica gel. Extraction and chromatography solvents were bought and used without further purification from Fisher Scientific, U.K. All chemicals were purchased from Aldrich, Lancaster or BDH.

$^1$H and $^{13}$C NMR spectra were obtained on a Bruker Avance 400 spectrometer. Coupling constants are quoted in hertz (Hz). Chemical shifts are recorded in parts per million (ppm) downfield from tetramethylsilane. Spin multiplicities are described as s (singlet), bs (broad singlet), d (doublet), t (triplet), q (quartet), p (pentuplet) and m (multiplet).

LCMS Method

The HPLC (Shimazu LCMS-2020) was run using a mobile phase of water (A) (formic acid 0.1%) and acetonitrile (B) (formic acid 0.1%). Gradient: initial composition 5% B held over 0.25 min, then increase from 5% B to 100% B over a 2 min period. The composition was held for 0.50 min at 100% B, then returned to 5% B in 0.05 minutes and hold there for 0.05 min. Total gradient run time equals 3 minutes.

Flow rate 0.8 mL/min. Wavelength detection range: 220 to 400 nm. Column: Waters Acquity UPLC BEH Shield RP18 1.7 μm 2.1×50 mm.

Synthesis of Key Intermediates (a) 5-(benzyloxy)-4-((5-(4-carboxy-2-methoxy-5-nitrophenoxy)pentyl)oxy)-2-nitrobenzoic acid (I7)

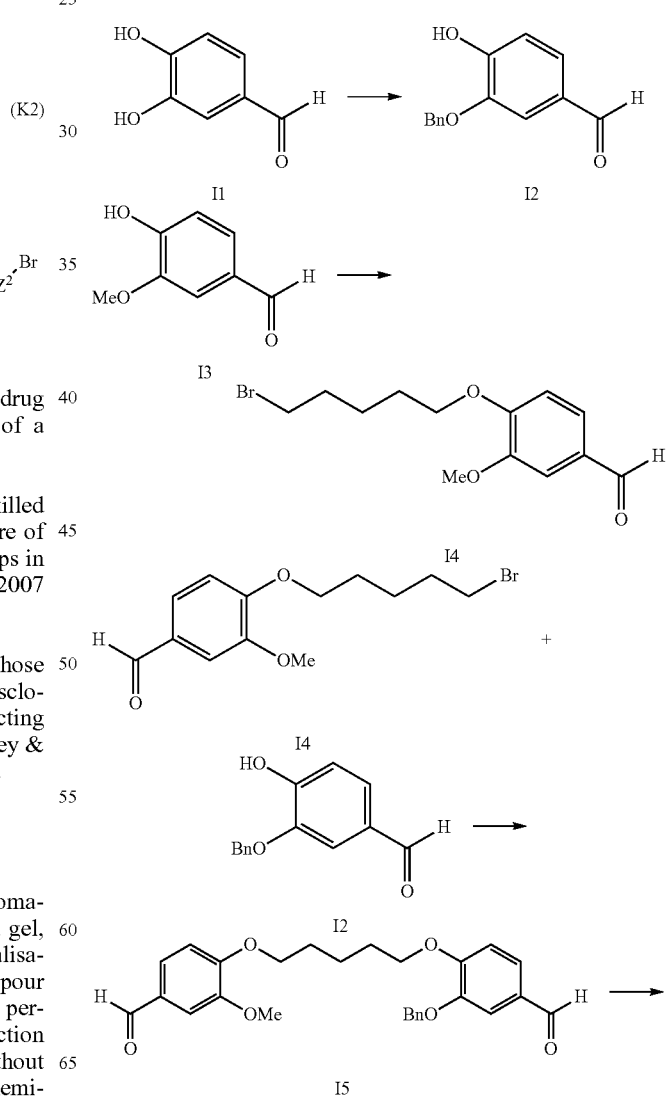

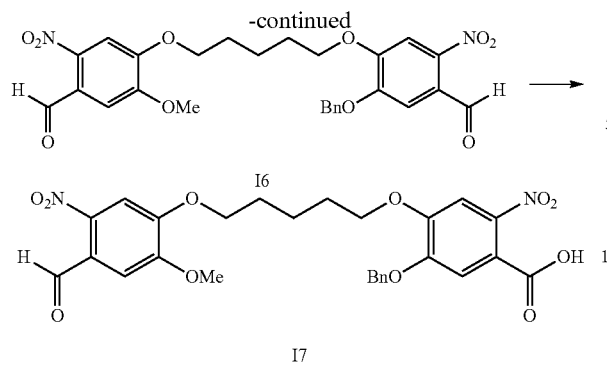

(i) 3-(benzyloxy)-4-hydroxybenzaldehyde (I2)

Sodium hydride (51.2 g, 1.27 mol, 2.2 eq) was rinsed twice with hexane in a three-neck flask and anhydrous DMSO (800 mL) was added. The flask was placed in a water bath at room temperature. A solution of 3,4-dihydroxybenzaldehyde I1 (80 g, 579.2 mmol) in dry DMSO (160 mL) was added dropwise, with an addition funnel, over 40 minutes and the reaction mixture was stirred 30 minutes under Argon. During the addition a lot of hydrogen gas is formed, so an exit with cotton wool and calcium chloride is placed in one of the neck. Benzyl bromide (68.8 mL, 579.2 mmol, 1 eq) was then added dropwise and the reaction was stirred overnight. The reaction mixture was poured into ice and quenched with HCl (1M) until pH acid and extracted with EtOAc. The organic phase was then washed with brine and was dried over magnesium sulphate, filtered and excess solvent was removed by rotary evaporation under reduced pressure. The resulting residue was subjected to a pad of Silica with pure dichloromethane. The resulting material was precipitated with a minimum of dichloromethane in hexane. The resulting white precipitate was filtered and dried to afford the desired compound (80.7 g, 60% yield). LC/MS 1.43 min (no ionisation). $^1$H NMR (400 MHz, CDCl$_3$) δ 9.81 (s, 1H), 7.51 (d, J=1.8 Hz, 1H), 7.45-7.34 (m, 7H), 7.06 (d, J=8.1 Hz, 1H), 6.24 (s, 1H), 5.17 (s, 2H).

(ii) 4-((5-bromopentyl)oxy)-3-methoxybenzaldehyde (I4)

Vanillin I3 (50 g, 328 mmol) was dissolved in acetone (1 L). Dibromopentane (227 g, 985 mmol, 3 eq) and potassium carbonate (68 g, 492 mmol, 1.5 eq) were added. The slurry was warmed to 65° C. and stirred for 2 hours, and then 80° C. for 30 minutes. The resulting potassium carbonate was filtered and the excess solvent was removed by rotary evaporation under reduced pressure. The resulting residue was subjected to a pad of Silica: 7.5% EtOAc in Hexane (4 L) then 10% EtOAc in Hexane (1 L) and 25% EtOAc in Hexane to afford a white solid (53.7 g, 54% yield). LC/MS 1.63 min (ES+) m/z (relative intensity) 302.53 ([M+H]$^+$, 100). $^1$H NMR (400 MHz, CDCl$_3$) δ 9.83 (s, 1H), 7.42 (dd, J=8.1, 1.9 Hz, 1H), 7.40 (d, J=1.9 Hz, 1H), 6.95 (d, J=8.1 Hz, 1H), 4.10 (t, J=6.6 Hz, 2H), 3.91 (s, 3H), 3.43 (t, J=6.7 Hz, 2H), 1.92 (m, 4H), 1.64 (tt, J=9.7, 6.2 Hz, 2H).

(iii) 3-(benzyloxy)-4-((5-(4-formyl-2-ethoxyphenoxy)pentyl)oxy) benzaldehyde (I5)

4-((5-bromopentyl)oxy)-3-methoxybenzaldehyde I4 (40.0 g, 132.81 mmol, 1 eq) and 3-(benzyloxy)-4-hydroxybenzaldehyde I2 (30.3 g, 132.81 mmol, 1 eq) were dissolved in dimethylformamide (200 mL). Potassium carbonate (13.8 g, 99.61 mmol, 0.75 eq) and tetrabutylammonium iodide (4.9 g, 13.28 mmol, 0.1 eq) were added. The reaction mixture was warmed to 80° C. and stirred for 12 hours. The resulting potassium carbonate was filtered and the excess solvent was removed by rotary evaporation under reduced pressure. The resulting residue was dissolved in Ethyl acetate and washed subsequently with water, 1N NaOH, 1N HCl, water and brine. The organic phase was dried over magnesium sulphate, filtered and excess solvent was removed by rotary evaporation under reduced pressure to afford the desired compound (75 g, quantitative yield) as a light yellow oil. LC/MS 1.77 min (ES+) m/z (relative intensity) 449.15 [M+H]$^+$, 471.25 [M+Na]$^+$. $^1$H NMR (400 MHz, CDCl$_3$) δ 9.83 (s, 1H), 9.81 (s, 1H), 7.46 (dd, J=3.1, 1.4 Hz, 2H), 7.43 (d, J=1.7 Hz, 2H), 7.41 (dd, J=8.1, 1.9 Hz, 1H), 7.39 (d, J=1.8 Hz, 1H), 7.37-7.32 (m, 2H), 7.30 (dd, J=5.0, 3.6 Hz, 1H), 6.97 (d, J=8.1 Hz, 1H), 6.92 (d, J=8.1 Hz, 1H), 5.15 (s, 2H), 4.13 (t, J=6.4 Hz, 2H), 4.09 (t, J=6.6 Hz, 2H), 3.88 (s, 3H), 2.01-1.89 (m, 4H), 1.77-1.64 (m, 2H).

(iv) 5-(benzyloxy)-4-((5-(4-formyl-2-methoxy-5-nitrophenoxy)pentyl)oxy)-2-nitrobenzaldehyde (I6)

3-(benzyloxy)-4-((5-(4-formyl-2-ethoxyphenoxy)pentyl) oxy) benzaldehyde I5 (30 g, 66.40 mmol) was dissolved in dichloromethane (60 mL) and added to nitric acid (68%, 60 mL) at 0° C. The reaction mixture was stirred at 0° C. for 20 minutes and at room temperature for 3 hours. The reaction mixture gets darker after 1 hour. After 2 hours, the LCMS showed no more starting material, so cold water was added and the precipitate was filtered and washed with water. The white solid was dried by vacuum. 42 g of white solid was obtained (>100% yield due to water remaining). LC/MS 1.88 min, no ionisation. $^1$H NMR (400 MHz, CDCl$_3$) δ 10.44 (s, 1H), 10.41 (s, 1H), 7.61 (s, 1H), 7.56 (s, 1H), 7.48 (s, 1H), 7.46-7.30 (m, 6H), 5.25 (s, 2H), 4.20 (dd, J=12.2, 5.9 Hz, 2H), 4.13 (dd, J=15.1, 8.7 Hz, 2H), 3.96 (s, 3H), 2.01 (dt, J=14.1, 6.4 Hz, 4H), 1.80-1.65 (m, 2H).

(v) 5-(benzyloxy)-4-((5-(4-carboxy-2-methoxy-5-nitrophenoxy)pentyl)oxy)-2-nitrobenzoic acid (I7)

A solution of sodium chlorite (35.3 g, 390 mmol, 5 eq) and sodium phosphate (26.2 g, 218.4 mmol, 2.8 eq) in water (250 mL) was added to a solution of 5-(benzyloxy)-4-((5-(4-formyl-2-methoxy-5-nitrophenoxy)pentyl)oxy)-2 nitrobenzaldehyde I6 (42 g, 78 mmol) in THF (200 mL). Hydrogen peroxide (60%, 103 mL, 2.18 mol, 28 eq) was then added quickly. No more starting material was observed after 30 minutes by LCMS/TLC. The reaction was then quenched with 1N HCl and extracted with ethyl acetate. The organic layer was washed two times with brine, dried over magnesium sulphate; filtered and excess solvent was removed by rotary evaporation under reduced pressure. The resulting residue was dissolved in a minimum of dichloromethane and precipitated out with ether. Pale yellow solid (26 g, 58%) was filtered and washed with ether and used as crude for the next reaction.

LC/MS 1.69 min (ES+) m/z (relative intensity) 569.35 [M+H]$^+$.

(b) (2R,11aS)-2-((tert-butyldimethylsilyl)oxy)-8-((5-((((2R,11aS)-2-((tert-butyldimethylsilyl)oxy)-5,11-dioxo-7-((triisopropylsilyl)oxy)-10-((2-(trimethylsilyl)ethoxy)methyl)-2,3,5,10,11,11a-hexahydro-1H-benzo[e]pyrrolo[1,2-a][1,4]diazepin-8-yl)oxy)pentyl)oxy)-7-methoxy-10-((2-(trimethylsilyl)ethoxy)methy)-2,3-dihydro-1H-benzo[e]pyrrolo[1,2-a][1,4]diazepine-5,11(10H,11aH)-dione (I13)
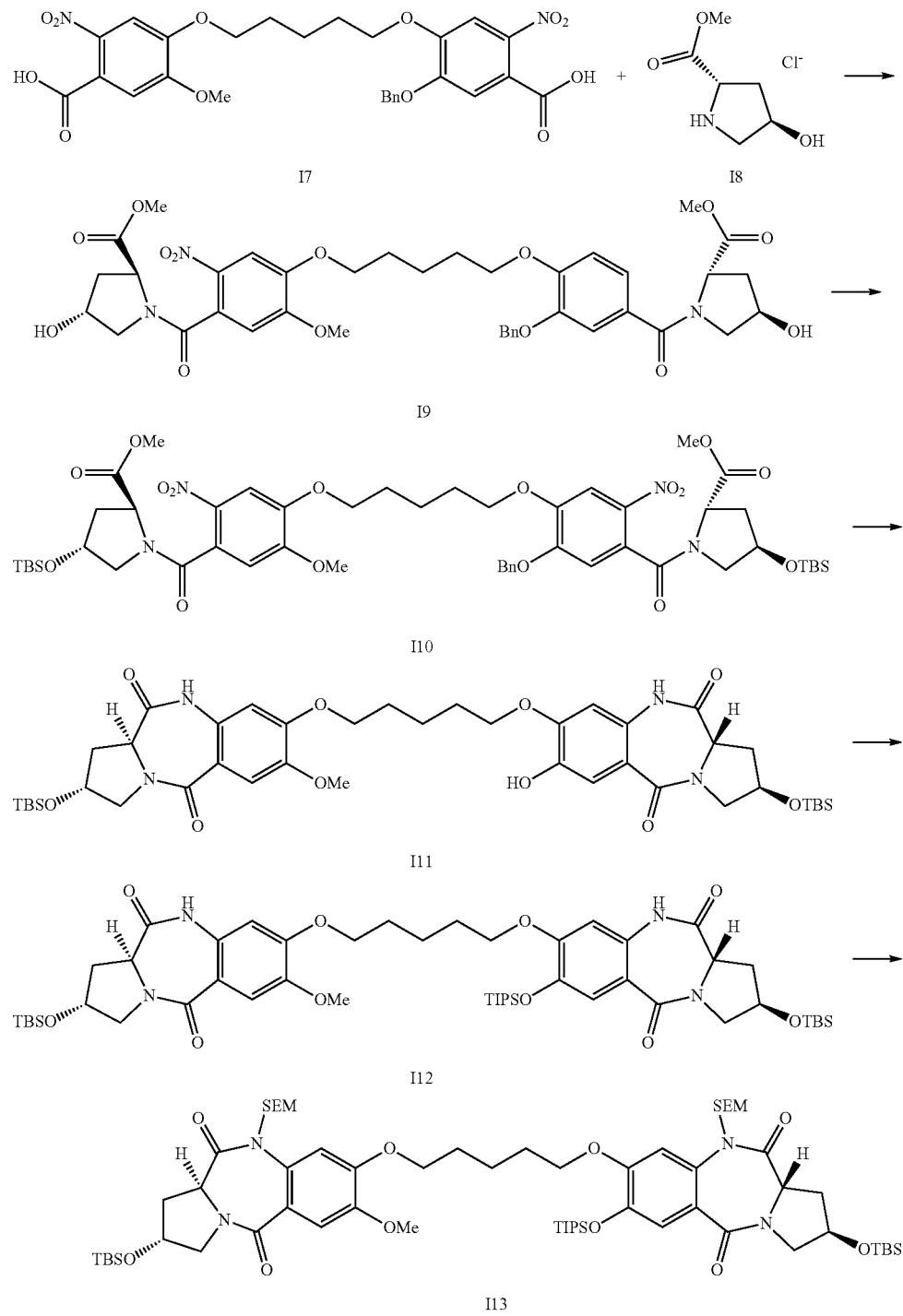

113

(i) (2S,4R)-methyl 1-(4-((5-(2-(benzyloxy)-4-((2S,4R)-4-hydroxy-2-(methoxycarbonyl)pyrrolidine-1-carbonyl)-5-nitrophenoxy)pentyl)oxy)-5-methoxy-2-nitrobenzoyl)-4-hydroxypyrrolidine-2-carboxylate (I9)

Oxalyl chloride (7.6 mL, 89.92 mmol, 3 eq) was added to a solution of I7 (17.1 g, 29.97 mmol) in dichloromethane (150 mL) and DMF (2 mL). After 20 min, a sample is taken and a small workup with MeOH is done. LCMS of this sample showed only one pic at 1.87 min and no starting material. The solvent was solvent was removed by rotary evaporation under reduced pressure and minimum of dichloromethane was added to dissolve the crude and triturated with diethyl ether. The yellow solid formed was filtered and added portion wise to a solution of 10 (13.6 g, 74.93 mmol, 2.5 eq) and triethylamine (20.92 mL, 149.87 mmol, 5 eq) in dichloromethane (100 mL) at −40° C. The reaction was complete after few minutes. The solvent was removed by rotary evaporation under reduced pressure and the resulting residue was subjected to flash column chromatography (silica gel; 50% ethyl acetate in hexane to 100% ethyl acetate to collect the mono addition product and then 5% to 20% methanol in dichloromethane). Pure fractions were collected and combined and excess eluent was removed by rotary evaporation under reduced pressure to give the product (15 g, 61% over 3 steps). LC/MS 1.47 min (ES+) m/z (relative intensity) 825.45 ([M+H]$^+$, 100). $^1$H NMR (400 MHz, CDCl$_3$) δ 7.65 (s, 1H), 7.61 (s, 1H), 7.45-7.27 (m, 5H), 6.89 (s, 1H), 6.81 (s, 1H), 5.20 (s, 2H), 4.85-4.74 (m, 2H), 4.40 (d, J=20.3 Hz, 2H), 4.21-4.02 (m, 4H), 3.91 (s, 3H), 3.79 (s, 6H), 3.53-3.41 (m, 2H), 3.13 (d, J=11.1 Hz, 1H), 3.04 (d, J=11.0 Hz, 1H), 2.79-2.72 (m, J=4.3 Hz, 1H), 2.63 (s, 1H), 2.42-2.32 (m, 2H), 2.21-2.06 (m, J=11.3 Hz, 2H), 2.02-1.89 (m, 4H), 1.76-1.65 (m, 2H).

(ii) (2S,4R)-methyl 1-(4-((5-(2-(benzyloxy)-4-((2S,4R)-4-((tert-butyldimethylsilyl)oxy)-2-(methoxycarbonyl)pyrrolidine-1-carbonyl)-5-nitrophenoxy)pentyl)oxy)-5-methoxy-2-nitrobenzoyl)-4-((tert-butyldimethylsilyl)oxy)pyrrolidine-2-carboxylate (I10)

I9 (14 g, 16.97 mmol), tert-butyldimethylsilyl chloride (12.8 g, 84.87 mmol, 5 eq) and imidazole (13.9 g, 203.64 mmol, 12 eq) were melted together at 120° C. (a drop of dichloromethane was added to mix the different solids on the side of the flask). The reaction was complete after 30 minutes. The resulting residue was subjected to flash column chromatography (silica gel; 10% ethyl acetate in hexane to 100% ethyl acetate). Pure fractions were collected and combined and excess eluent was removed by rotary evaporation under reduced pressure to give the product (17 g, quantitative).

LC/MS 2.17 min. $^1$H NMR (400 MHz, CDCl$_3$) δ 7.69 (s, 1H), 7.65 (s, 1H), 7.43-7.27 (m, 5H), 6.87 (s, 1H), 6.78 (s, 1H), 5.17 (d, J=5.6 Hz, 2H), 4.73-7.79 (m, 2H), 4.45-4.34 (m, 2H), 4.32-4.10 (m, 2H), 4.09-4.00 (m, 2H), 3.90 (s, 3H), 3.80 (s, 3H), 3.79 (s, 3H), 3.48-3.41 (m, 1H), 3.29 (dd, J=10.3, 4.6 Hz, 1H), 3.03 (dd, J=10.4, 2.4 Hz, 2H), 2.96 (dd, J=10.2, 2.8 Hz, 2H), 2.31-2.21 (m, 2H), 2.19-2.05 (m, 2H), 2.00-1.88 (m, 4H), 1.74-1.66 (m, 2H), 0.82 (s, 18H), 0.02 (d, J=1.1 Hz, 6H), −0.03 (d, J=5.5 Hz, 6H).

(iii) (2R,11aS)-2-((tert-butyldimethylsilyl)oxy)-8-((5-(((2R,11aS)-2-((tert-butyldimethylsilyl)oxy)-7-hydroxy-5,11-dioxo-2,3,5,10,11,11a-hexahydro-1H-benzo[e]pyrrolo[1,2-a][1,4]diazepin-8-yl)oxy)pentyl)oxy)-7-methoxy-2,3-dihydro-1H-benzo[e]pyrrolo[1,2-a][1,4]diazepine-5,11(10H,11aH)-dione (I11)

Ammonium formate (106 g, 168 mmol, 10 eq) was added to a solution of I10 (17.7 g, 16.80 mmol) in ethanol (500 mL). Palladium on carbon (1.8 g, 10%) was wetted with ethyl acetate and added to the reaction mixture. The solution was warmed to 70° C. (at 69° C., yellow then white gas formed). Termination of the evolution of gas marked the completion of the reaction (around 20 min). The reaction mixture was then filtered through celite and washed with ethyl acetate. The solvent was removed by rotary evaporation. The residue was dissolved in ethyl acetate and washed with saturated aqueous ammonium chloride and brine, dried over magnesium sulphate; filtered and excess solvent was removed by rotary evaporation under reduced pressure to give the desired compound (13.9 g, 98%) as a yellow gum.

LC/MS 1.91 min, (ES+) m/z (relative intensity) 839.35 ([M+H]$^+$, 100).

(iv) (2R,11aS)-2-((tert-butyldimethylsilyl)oxy)-8-((5-(((2R,11aS)-2-((tert-butyldimethylsilyl)oxy)-5,11-dioxo-7-((triisopropylsilyl)oxy)-2,3,5,10,11,11a-hexahydro-1H-benzo[e]pyrrolo[1,2-a][1,4]diazepin-8-yl)oxy)pentyl)oxy)-7-methoxy-2,3-dihydro-1H-benzo[e]pyrrolo[1,2-a][1,4]diazepine-5,11(10H,11aH)-dione (I12)

I11 (13.9 g, 16.56 mmol), triisopropylsilyl chloride (3.6 mL, 18.36 mmol, 1.1 eq) and imidazole (3.4 g, 49.94 mmol, 3 eq) were melted together at 120° C. (a drop of dichloromethane was added to mix the different solids on the side of the flask). The reaction was complete after 30 minutes. The resulting residue was subjected to flash column chromatography (silica gel; 10% ethyl acetate in hexane to 100% ethyl acetate). Pure fractions were collected and combined and excess eluent was removed by rotary evaporation under reduced pressure to give the product (15.4 g, 93%). LC/MS 2.31 min, $^1$H NMR (400 MHz, CDCl$_3$) δ 9.81 (s, 1H), 8.70 (s, 1H), 8.65 (s, 1H), 7.43 (s, 2H), 6.47 (s, 1H), 6.42 (s, 1H), 4.54-4.43 (m, 2H), 4.17 (dt, J=7.6, 3.8 Hz, 2H), 4.00 (t, J=6.4 Hz, 2H), 3.95 (t, J=6.2 Hz, 2H), 3.87 (s, 3H), 3.73-3.58 (m, 4H), 2.84-2.76 (m, 2H), 2.09-1.96 (m, 1H), 1.92-1.85 (m, 4H), 1.68-1.62 (m, 2H), 1.31-1.17 (m, 3H), 1.08 (d, J=2.5 Hz, 9H), 1.06 (d, J=2.5 Hz, 9H), 0.85 (s, 9H), 0.84 (s, 9H), 0.06 (s, 6H), 0.07 (s, 6H).

(v) (2R,11aS)-2-((tert-butyldimethylsilyl)oxy)-8-((5-(((2R,11aS)-2-((tert-butyldimethylsilyl)oxy)-5,11-dioxo-7-((triisopropylsilyl)oxy)-10-((2-(trimethylsilyl)ethoxy)methyl)-2,3,5,10,11,11a-hexahydro-1H-benzo[e]pyrrolo[1,2-a][1,4]diazepin-8-yl)oxy)-7-methoxypentyl)oxy)-7-methoxy-10-((2-(trimethylsilyl)ethoxy)methyl)-2,3-dihydro-1H-benzo[e]pyrrolo[1,2-a][1,4]diazepine-5,11(10H,11aH)-dione (I13)

I12 (15.4 g, 15.74 mmol) was dissolved in dry tetrahydrofuran (250 mL) and cooled to −30° C. (dry ice/acetone). n-Butyllithium (29 mL, 46.41 mmol, 3 eq) was then added dropwise and the reaction mixture was stirred for 1 hour at −30° C. 2-(Trimethylsilyl)ethoxymethyl chloride (8.2 mL, 46.41 mmol, 3 eq) was then added dropwise and the cold bath was removed. The reaction mixture was stirred at ambient temperature for 12 hours and the solvent was removed by rotary evaporation. The residue was dissolved in ethyl acetate and washed with water and brine, dried over magnesium sulphate; filtered and excess solvent was removed by rotary evaporation under reduced pressure to give the desired compound as yellow oil used as crude for the next reaction. ¹H NMR (400 MHz, CDCl₃) δ 7.34 (s, 1H), 7.33 (s, 1H), 7.20 (s, 1H), 7.15 (s, 1H), 5.49 (dd, J=10.0, 1.8 Hz, 2H), 4.64 (dd, J=9.9, 7.5 Hz, 2H), 4.56 (dt, J=8.9, 5.7 Hz, 2H), 4.21 (dt, J=8.6, 4.4 Hz, 2H), 4.09-3.93 (m, 4H), 3.91 (s, 3H), 3.82-3.61 (m, 6H), 3.61-3.50 (m, 2H), 2.90-2.76 (m, 2H), 2.03-1.97 (m, 2H), 1.97-1.86 (m, 4H), 1.75-1.64 (m, 2H), 1.34-1.19 (m, 3H), 1.10 (d, J=2.7 Hz, 9H), 1.08 (d, J=2.7 Hz, 9H), 0.96 (ddd, J=9.1, 6.9, 2.0 Hz, 4H), 0.86 (d, J=2.9 Hz, 9H), 0.85 (d, J=2.9 Hz, 9H), 0.09 (s, 6H), 0.07 (s, 6H), 0.01 (d, J=3.2 Hz, 18H).

(c) (S)-7-hydroxy-8-((5-(((S)-7-methoxy-2-methyl-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-2-methyl-10-((2-(trimethylsilyl)ethoxy)methyl)-1H-benzo[e]pyrrolo[1,2-a][1,4]diazepine-5,11(10H,11aH)-dione (I18)

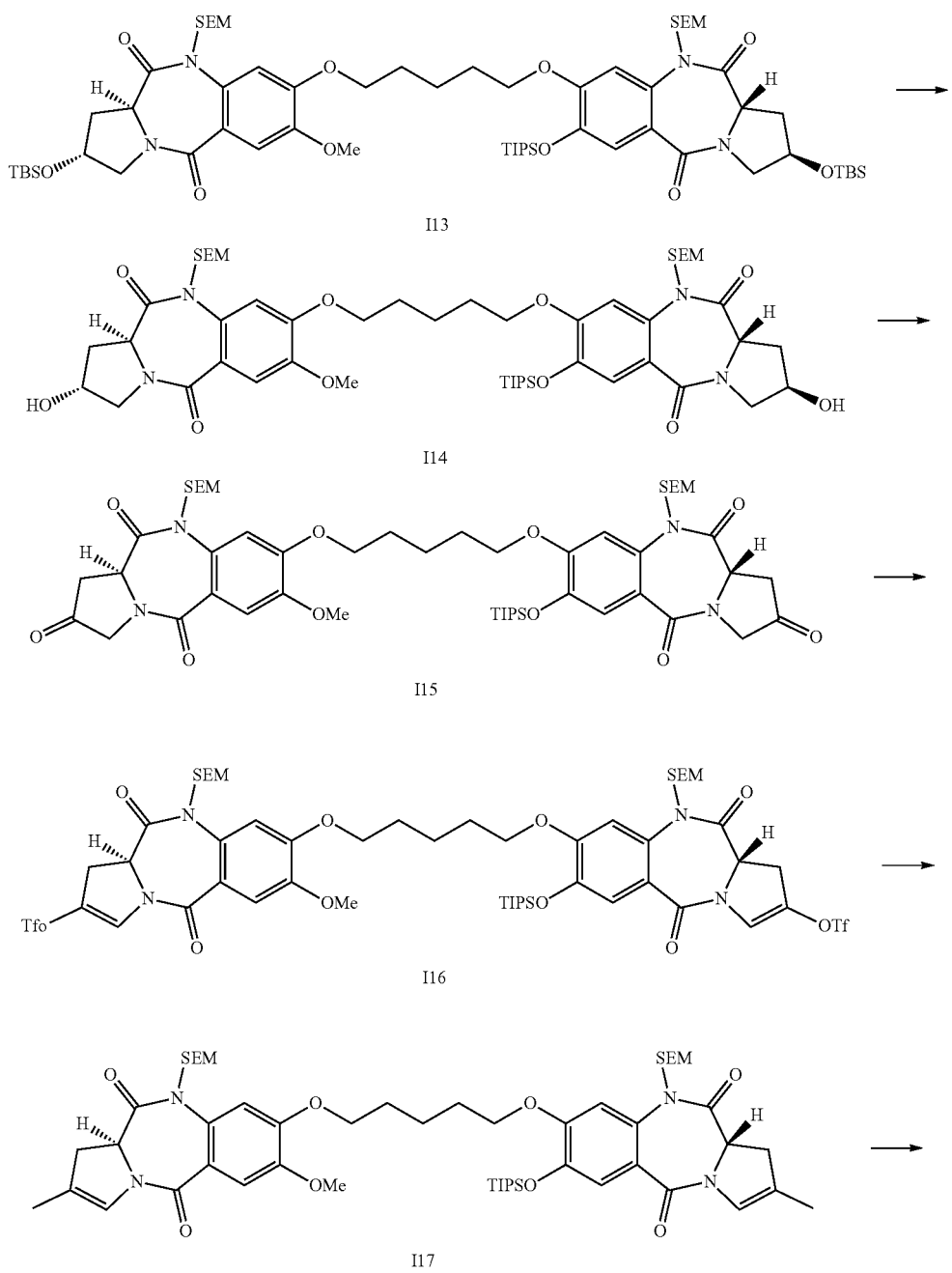

-continued

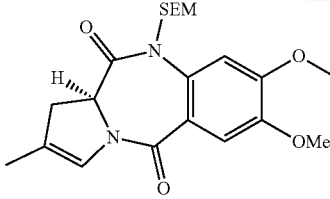 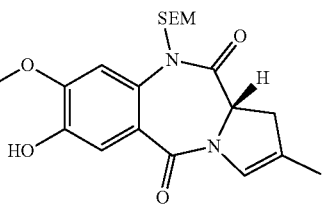

I18

(i) (2R,11aS)-2-hydroxy-8-((5-(((2R,11aS)-2-hydroxy-5,11-dioxo-7-((triisopropylsilyl)oxy)-10-((2-(trimethylsilyl)ethoxy)methyl)-2,3,5,10,11,11a-hexahydro-1H-benzo[e]pyrrolo[1,2-a][1,4]diazepin-8-yl)oxy)pentyl)oxy)-7-methoxy-10-((2-(trimethylsilyl)ethoxy)methyl)-2,3-dihydro-1H-benzo[e]pyrrolo[1,2-a][1,4]diazepine-5,11(10H,11aH)-dione (I14)

Crude I13 (15.74 mmol) was dissolved in dry tetrahydrofuran (40 mL) and a solution of 1% v/v conc. HCl in methanol (120 mL). The reaction mixture was stirred 2 hours at ambient temperature; diluted with ethyl acetate and washed with water (two times), saturated aqueous sodium bicarbonate and brine, dried over magnesium sulphate; filtered and excess solvent was removed by rotary evaporation under reduced pressure to give the desired compound as yellow oil used as crude for the next reaction. LC/MS 2.08 min, (ES+) m/z (relative intensity) 1027.40 [M+H]$^+$, $^1$H NMR (400 MHz, CDCl$_3$) δ 7.32 (s, 1H), 7.32 (s, 1H), 7.20 (s, 1H), 7.14 (s, 1H), 5.49 (dd, J=10.0, 3.2 Hz, 2H), 4.69-4.57 (m, 3H), 4.33-4.24 (m, 2H), 4.16-3.93 (m, 4H), 3.88 (s, 3H), 3.89-3.55 (m, 6H), 3.00-2.88 (m, 2H), 2.53 (br, 1H), 2.17-2.05 (m, 2H), 2.00-1.86 (m, 4H), 1.78-1.63 (m, 3H), 1.46-1.39 (m, 2H), 1.36-1.19 (m, 4H), 1.09 (s, 9H), 1.07 (s, 9H), 1.01-0.92 (m, 4H), 0.02 (s, 18H).

(ii) (S)-7-methoxy-10-((2-(trimethyl)-8-((5-(((S)-2,5,11-trioxo-7-((triisopropylsilyl)oxy)-10-((2-(trimethylsilyl)ethoxy)methyl)-2,3,5,10,11,11a-hexahydro-1H-benzo[e]pyrrolo[1,2-a][1,4]diazepin-8-yl)oxy)pentyl)oxy)-1H-benzo[e]pyrrolo[1,2-a][1,4]diazepine-2,5,11(3H,10H,11aH)-trione (I15)

TCCA (1.62 g, 7.00 mmol, 1.2 eq) was added to a solution of crude I14 (5.84 mmol), TEMPO (90 mg, 0.58 mmol, 0.1 eq) and sodium acetate (1.14 g, 14.00 mmol, 2.4 eq) in dichloromethane (120 mL) at −10° C. (acetone/ice). The reaction was stirred for 30 min and filtered through celite. The reaction mixture was then quenched with saturated aqueous sodium bicarbonate. The organic phase washed with sodium thiosulfate and brine, dried over magnesium sulphate; filtered and excess solvent was removed by rotary evaporation under reduced pressure. The resulting residue was subjected to flash column chromatography (silica gel; 20% to 70% ethyl acetate in hexane). Pure fractions were collected and combined and excess eluent was removed by rotary evaporation under reduced pressure to give the product (3.21 g, 54% over 3 steps). LC/MS 2.17 min, (ES+) m/z (relative intensity) 1023.75 [M+H]$^+$, $^1$H NMR (400 MHz, CDCl$_3$) δ 7.32 (s, 2H), 7.23 (s, 1H), 7.18 (s, 1H), 5.53 (dd, J=10.0, 1.6 Hz, 2H), 4.70 (t, J=9.6 Hz, 2H), 4.66-4.58 (m, 2H), 4.22 (d, J=20.1 Hz, 2H), 4.13-3.95 (m, 4H), 3.91 (s, 3H), 3.89-3.74 (m, 4H), 3.72-3.62 (m, 2H), 3.56 (ddd, J=19.2, 5.8, 3.1 Hz, 2H), 2.78 (dd, J=19.3, 9.9 Hz, 2H), 1.95 (dd, J=14.6, 7.3 Hz, 4H), 1.76-1.63 (m, 2H), 1.33-1.23 (m, 3H), 1.10 (s, 9H), 1.09 (s, 9H), 1.02-0.90 (m, 4H), 0.02 (s, 18H).

(iii) (S)-8-((5-(((S)-5,11-dioxo-2-(((trifluoromethyl)sulfonyl)oxy)-7-((triisopropylsilyl)oxy)-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-2-yl trifluoromethanesulfonate (I16)

Anhydrous 2,6-lutidine (2.12 mL, 18.17 mmol, 6.2 eq) was injected in one portion to a solution of I15 (3 g, 2.93 mmol) in dry dichloromethane (40 mL) at −50° C. (acetone/dry ice). Triflic anhydride (2.12 mL, 18.17 mmol, 6 eq) was then added slowly whilst monitoring the temperature. After 20 minutes, the reaction, following a mini work-up (dichloromethane/water), was revealed to be complete by LC/MS. Cold water was added to the still cold reaction mixture and the organic layer was separated and washed with cold saturated sodium bicarbonate, brine, dried over magnesium sulphate; filtered and excess solvent was removed by rotary evaporation under reduced pressure. The resulting residue was subjected to flash column chromatography (silica gel; 5% to 20% ethyl acetate in hexane). Pure fractions were collected and combined and excess eluent was removed by rotary evaporation under reduced pressure to give the product (3.1 g, 82%). LC/MS 2.37 min, no ionisation, $^1$H NMR (400 MHz, CDCl$_3$) δ 7.32 (s, 2H), 7.23 (s, 1H), 7.19 (s, 1H), 7.14 (s, 1H), 7.11 (s, 1H), 5.54 (d, J=10.0 Hz, 2H), 4.74-4.66 (m, 2H), 4.63 (d, J=11.0 Hz, 2H), 4.09-3.96 (m, 4H), 3.94-3.87 (m, 2H), 3.90 (s, 3H), 3.82-3.76 (m, 2H), 3.69-3.65 (m, 2H), 3.22-3.08 (m, 2H), 1.99-1.90 (m, 4H), 1.75-1.64 (m, 2H), 1.33-1.21 (m, 3H), 1.11 (d, J=1.1 Hz, 9H), 1.09 (d, J=1.1 Hz, 9H), 1.01-0.91 (m, 4H), 0.02 (s, 18H).

(iv) (S)-7-methoxy-2-methyl-8-((5-(((S)-2-methyl-5,11-dioxo-7-((triisopropylsilyl)oxy)-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-10-((2-(trimethylsilyl)ethoxy)methyl)-1H-benzo[e]pyrrolo[1,2-a][1,4]diazepine-5,11(10H,11aH)-dione (I17)

Triphenylarsine (588 mg, 1.92 mmol, 0.8 eq) was added to a mixture of triflate I16 (3.1 g, 2.4 mmol, 1 eq), methylboronic acid (1.0 g, 16.8 mmol, 7 eq), silver oxide (4.45 g, 19.2 mmol, 8 eq) and potassium phosphate tribasic (6.1 g, 28.8 mmol, 12 eq) in dry dioxane (40 mL) under an argon atmosphere. The reaction was flushed with argon 3 times and bis(benzonitrile)palladium(II) chloride (184 mg, 0.48 mmol, 0.2 eq) was added. The reaction was flushed with argon 3 more times before being stirred at 70° C. After 1 hour the reaction was observed to be complete by TLC and filtered through a pad celite. The solvent was removed by rotary evaporation under reduced pressure. The resulting residue was subjected to column flash chromatography (silica gel; 20% to 50% ethyl acetate/hexane). Pure fractions were collected and combined, and excess eluent was removed by rotary evaporation under reduced pressure afforded the product (1.1 g, 36%). LC/MS 2.34 min, no ionisation, $^1$H NMR (400 MHz, CDCl$_3$) δ 7.35 (s, 2H), 7.20 (s, 1H), 7.16 (s, 1H), 6.68 (d, J=1.3 Hz, 1H), 6.64 (d, J=1.4 Hz, 1H), 5.53 (s, 1H), 5.51 (s, 1H), 4.67 (t, J=10.1 Hz, 2H), 4.45 (dt, J=10.5, 3.2 Hz, 2H), 4.08-3.94 (m, 4H), 3.90 (s, 3H), 3.77 (dd, J=8.9, 7.5 Hz, 2H), 3.68 (dt, J=10.0, 5.2 Hz, 2H), 3.43 (d, J=16.5 Hz, 2H), 2.78 (d, J=10.4 Hz, 2H), 2.00-1.86 (m, 4H), 1.83 (s, 3H), 1.82 (s, 3H), 1.72-1.68 (m, 2H), 1.30-1.25 (m, 3H), 1.09 (s, 9H), 1.06 (s, 9H), 0.99-0.94 (m, 4H), 0.02 (s, 18H).

(v) (S)-7-hydroxy-8-((5-(((S)-7-methoxy-2-methyl-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-2-methyl-10-((2-(trimethylsilyl)ethoxy)methyl)-1H-benzo[e]pyrrolo[1,2-a][1,4]diazepine-5,11(10H,11aH)-dione (I18)

Lithium acetate (110 mg, 1.08 mmol, 1 eq) was added to a solution of compound I17 (1.1 g, 1.08 mmol) in wet dimethylformamide (20 mL, 50:1 DMF/water). The reaction was stirred for 12 hours at ambient temperature and diluted with ethyl acetate and washed with citric acid (pH ~3), brine, dried over magnesium sulphate; filtered and excess solvent was removed by rotary evaporation under reduced pressure to provide the product (1.03 g, quantitative).

LC/MS 1.98 min, (ES+) m/z (relative intensity) 863.35 [M+H]$^+$, $^1$H NMR (400 MHz, CDCl$_3$) δ 7.44 (s, 1H), 7.35 (s, 1H), 7.20 (s, 1H), 7.19 (s, 1H), 6.70-6.62 (m, 2H), 6.21 (br, 1H), 5.51 (dd, J=10.0, 5.3 Hz, 2H), 4.66 (dd, J=11.3, 10.1 Hz, 2H), 4.46 (dd, J=10.4, 3.2 Hz, 2H), 4.18-3.99 (m, 4H), 3.90 (s, 3H), 3.78 (td, J=9.7, 6.9 Hz, 2H), 3.67 (td, J=9.7, 6.8 Hz, 2H), 3.49-3.35 (m, 2H), 2.81-2.68 (m, 2H), 2.00-1.89 (m, 4H), 1.82 (s, 3H), 1.81 (s, 3H), 1.75-1.63 (m, 2H), 0.97 (ddd, J=9.9, 6.6, 3.3 Hz, 4H), 0.01 (s, 18H).

(d) Allyl ((S)-1-(((S)-1-((4-((((3-bromopropyl)carbamoyl)oxy)methyl)phenyl)amino)-1-oxopropan-2-yl)amino)-3-methyl-1-oxobutan-2-yl)carbamate (I21)

Triethylamine (0.35 mL, 2.51 mmol, 2.2 eq) was added to a stirred solution of the 3-bromopropylamine hydrobromide 120 (250 mg, 1.14 mmol) and triphosgene (122 mg, 0.41 mmol, 0.36 eq) in dry tetrahydrofuran (5 mL). The progress of the isocyanate reaction was monitored by periodically removing aliquots from the reaction mixture and quenching with methanol and performing LC/MS analysis. Once the isocyanate formation was complete a solution of the alloc-Val-Ala-PABOH 119 (650 mg, 1.71 mmol, 1.5 eq) and triethylamine (0.24 mL, 1.71 mmol, 1.5 eq) in dry tetrahydrofuran (5 mL) was rapidly added by injection to the freshly prepared isocyanate. The reaction mixture was allowed to stir at 40° C. for 2 hours. As the starting materials were not soluble, 1 mL of DMF was added and the reaction was stirred at 40° C. for 12 hours when it showed around 40% conversion. Excess solvent was removed by rotary evaporation under reduced pressure. The resulting residue was subjected to flash column chromatography (silica gel; gradient, 50% ethyl acetate to 100% ethyl acetate in hexane). Pure fractions were collected and combined and excess eluent was removed by rotary evaporation under reduced pressure to give the desired product (190 mg, 31%). LC/MS 1.48 min (no ionisation). $^1$H NMR (400 MHz, DMSO) δ 9.97 (s, 1H), 8.14 (d, J=7.0 Hz, 1H), 7.57 (d, J=8.5 Hz, 2H), 7.28 (d, J=8.5 Hz, 2H), 7.23 (d, J=8.6 Hz, 1H), 5.99-5.82 (m, 1H), 5.30 (d, J=17.2 Hz, 1H), 5.17 (d, J=10.2 Hz, 1H), 4.94 (s, 2H), 4.52-4.45 (m, 2H), 4.43-4.40 (m, 1H), 3.93-3.83 (m, 1H), 3.51 (t, J=6.6 Hz, 2H), 3.17 (d, J=5.0 Hz, 1H), 3.11 (dd, J=12.6, 6.6 Hz, 2H), 1.99-1.90 (m, 3H), 1.30 (d, J=7.1 Hz, 3H), 0.89 (t, J=7.1 Hz, 3H), 0.84 (d, J=6.7 Hz, 3H).

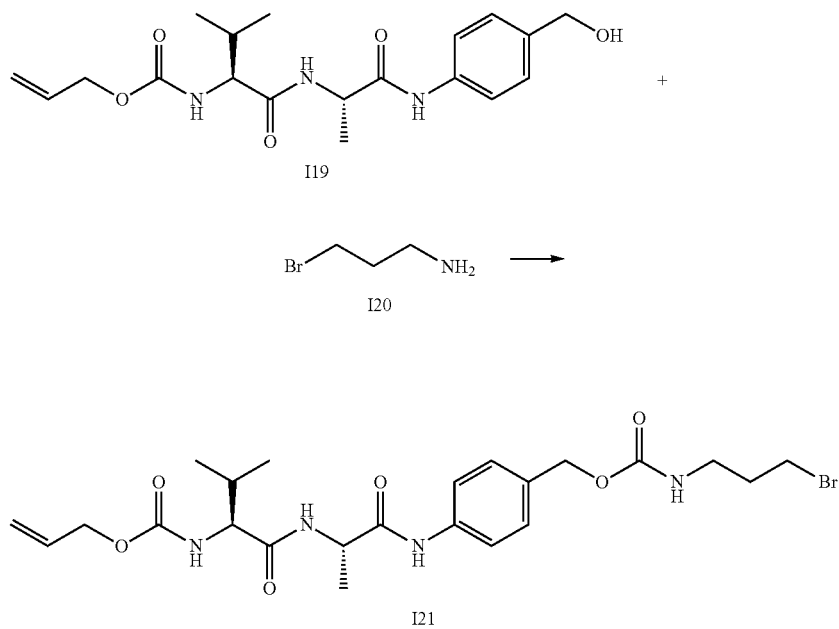

Example 1

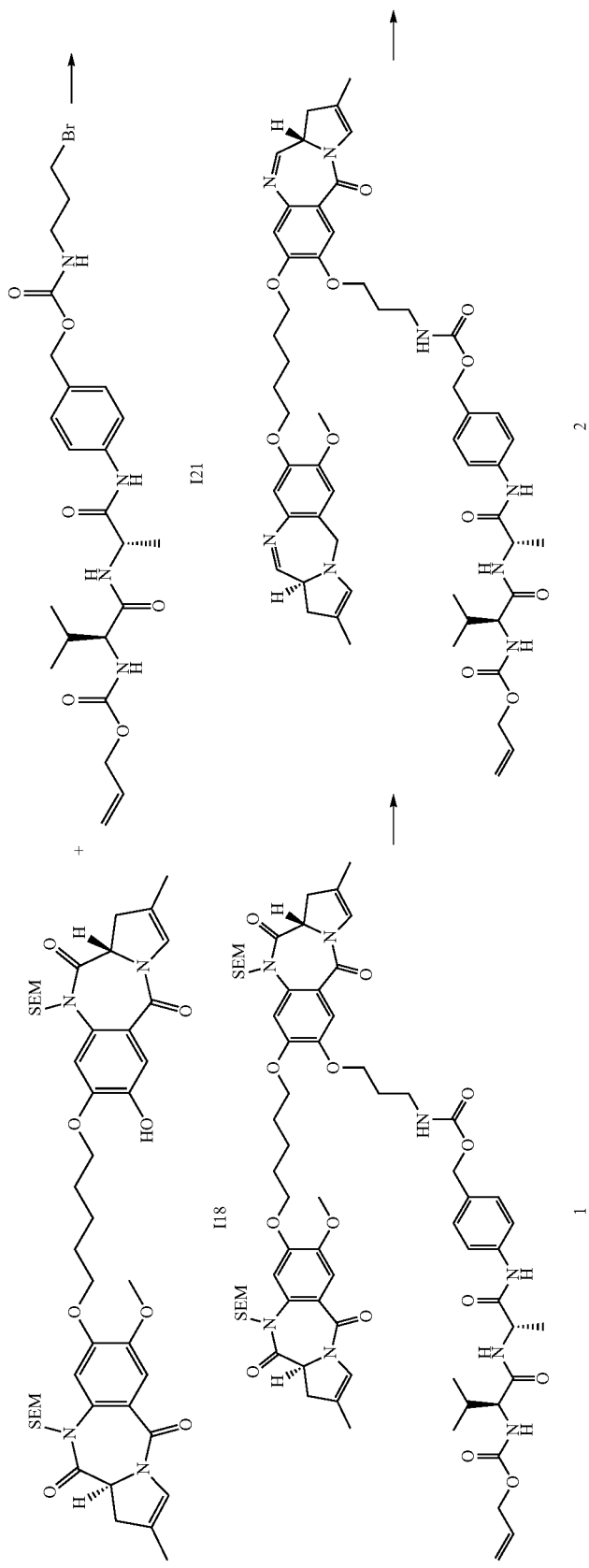

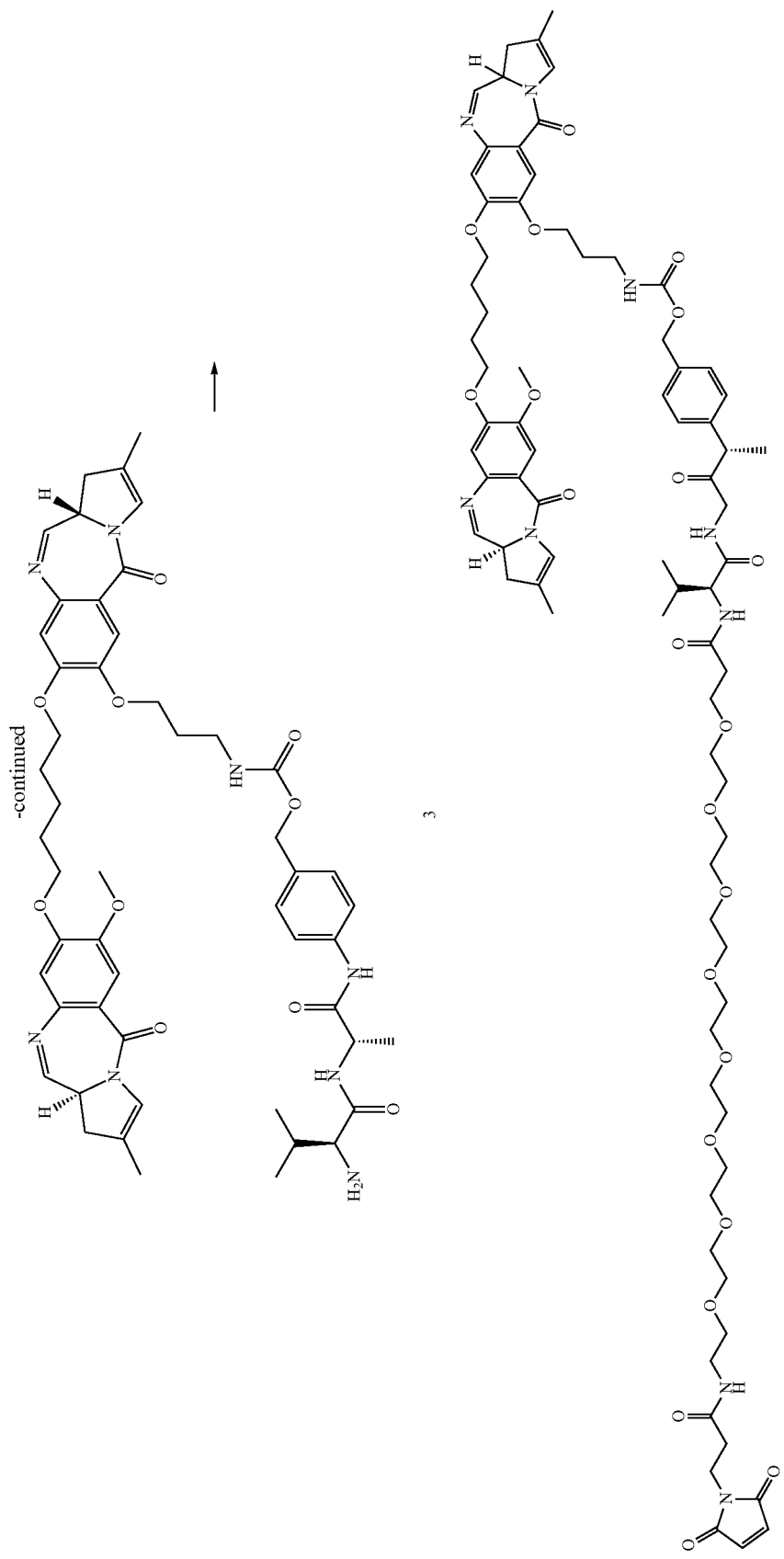

(a) 4-((S)-2-((S)-2-(((allyloxy)carbonyl)amino)-3-methylbutanamido)propanamido)benzyl(3-(((S)-8-((5-(((S)-7-methoxy-2-methyl-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-2-methyl-5,11-dioxo-10-((2-(trimethylsilyl)ethoxy)methyl)-5,10,11,11a-tetrahydro-1H-benzo[e]pyrrolo[1,2-a][1,4]diazepin-7-yl)oxy)propyl) carbamate (1)

Tetrabutylammonium iodide (16 mg, 0.042 mmol, 0.2 eq), potassium carbonate (43 mg, 0.314 mmol, 1.5 eq) and 121 (170 mg, 0.314 mmol, 1.5 eq) were added to a solution of alcohol I18 (180 mg, 0.209 mmol) in dimethylformamide (3 mL). The reaction mixture was stirred for 2 hour at 80° C. after when the reaction was observed to be complete by LC/MS. The reaction mixture was diluted with ethyl acetate and washed with water three times, brine, dried over magnesium sulphate; filtered and excess solvent was removed by rotary evaporation under reduced pressure. The resulting residue was subjected to flash column chromatography (silica gel; gradient, 50% ethyl acetate to 100% ethyl acetate in hexane). Pure fractions were collected and combined and excess eluent was removed by rotary evaporation under reduced pressure to give the desired product (180 mg, 65%). LC/MS 2.01 min, (ES+) m/z (relative intensity) 1323.45 [M+H]$^+$, $^1$H NMR (400 MHz, CDCl$_3$) δ 8.64 (s, 1H), 7.47 (d, J=8.1 Hz, 2H), 7.31 (s, 2H), 7.24-7.23 (m, 2H), 7.17 (s, 2H), 6.71-6.64 (m, 2H), 6.62 (d, J=7.5 Hz, 1H), 5.93-5.83 (m, 1H), 5.49 (dd, J=10.0, 2.2 Hz, 2H), 5.30-5.26 (m, 2H), 5.28 (d, J=17.0 Hz, 1H), 5.00 (s, 2H), 4.74-4.65 (m, 2H), 4.60-4.55 (m, 2H), 4.49-4.38 (m, 2H), 3.99 (br, 6H), 3.82 (s, 3H), 3.79-3.72 (m, 2H), 3.70-3.57 (m, 2H), 3.44-3.40 (m, 4H), 2.74 (dd, J=16.6, 10.8 Hz, 2H), 2.01 (br, 4H), 1.85-1.82 (m, 10H), 1.60 (br, 2H), 1.42 (d, J=6.8 Hz, 3H), 1.01-0.85 (m, 10H), 0.03-0.09 (m, 18H).

(b) 4-((S)-2-((S)-2-(((allyloxy)carbonyl)amino)-3-methylbutanamido)propanamido)benzyl (3-(((S)-8-((5-(((S)-7-methoxy-2-methyl-5-oxo-5,11a-dihydro-1H-benzo[e]pyrrolo[1,2-a][1,4]diazepin-8-yl)oxy)pentyl)oxy)-2-methyl-5-oxo-5,11a-dihydro-1H-benzo[e]pyrrolo[1,2-a][1,4]diazepin-7-yl)oxy)propyl)carbamate (2)

Compound 1 (180 mg, 0.136 mmol) was dissolved in dry THF (5 mL) and cooled to −78° C. Lithium triethylborohydride (0.34 mL, 0.34 mmol, 2.5 eq) was then added dropwise. The reaction was stirred under argon at −78° C. After 30 minutes, the reaction, following a mini work-up (water), was revealed to be complete by LC/MS. The cold bath was removed and water added. The reaction mixture was extracted with ethyl acetate and washed with brine, dried over magnesium sulphate; filtered and excess solvent was removed by rotary evaporation under reduced pressure. The resulting residue was dissolved with a mixture of dichloromethane/methanol/water (3/6/1, 2 mL/6 mL/0.7 mL). Silica gel was added until the solution gets thick and left stirring at ambient temperature for 5 days. The reaction mixture was filtered and washed with brine, dried over magnesium sulphate; filtered and excess solvent was removed by rotary evaporation under reduced pressure. The resulting residue was subjected to column flash chromatography (silica gel; 5% methanol/chloroform). Pure fractions were collected and combined, and excess eluent was removed by rotary evaporation under reduced pressure afforded the desired product (82 mg, 58%). LC/MS 1.49 min, (ES+) m/z (relative intensity) 1031.45 [M+H]$^+$, $^1$H NMR (400 MHz, CDCl$_3$) δ 8.73 (s, 1H), 7.87 (s, 1H), 7.81 (d, J=4.0 Hz, 1H), 7.48 (br, 4H), 7.28-2.26 (m, 2H), 7.17 (d, J=5.5 Hz, 1H), 6.80-6.75 (m, 4H), 5.92-5.89 (m, 1H), 5.78 (br, 1H), 5.30 (d, J=8.5 Hz, 2H), 5.22 (d, J=10.8 Hz, 1H), 5.02 (s, 2H), 4.61-4.57 (m, 4H), 4.27-4.24 (m, 2H), 4.05-3.76 (m, 6H), 3.87 (s, 3H), 3.79-3.70 (m, 2H), 3.49-3.37 (m, 4H), 3.22-3.10 (m, 1H), 2.98-2.94 (m, 1H), 2.20-2.08 (m, 1H), 2.02 (br, 4H), 1.84 (s, 3H), 1.79 (s, 3H), 1.41 (d, J=6.8 Hz, 3H), 1.02-0.82 (m, 6H).

(c) 4-((S)-2-((S)-2-amino-3-methylbutanamido)propanamido)benzyl (3-(((S)-8-((5-(((S)-7-methoxy-2-methyl-5-oxo-5,11a-dihydro-1H-benzo[e]pyrrolo[1,2-a][1,4]diazepin-8-yl)oxy)pentyl)oxy)-2-methyl-5-oxo-5,11a-dihydro-1H-benzo[e]pyrrolo[1,2-a][1,4]diazepin-7-yl)oxy)propyl)carbamate (3)

Tetrakis(triphenylphosphine)palladium(0) (6 mg, 0.005 mmol, 0.06 eq) was added to a solution of compound 2 (80 mg, 0.077 mmol) and pyrrolidine (16 μL, 0.193 mmol, 2.5 eq) in dry dichloromethane (2 mL). The reaction was flushed with argon three times and stirred 30 minutes at room temperature. Then the reaction was diluted with dichloromethane and washed sequentially with saturated aqueous ammonium chloride and brine. The organic phase was dried over magnesium sulphate filtered and excess dichloromethane removed by rotary evaporation under reduced pressure. The resulting residue was used as a crude mixture for the next reaction. LC/MS 1.15 min, (ES+) m/z (relative intensity) 947.55 [M+H]$^+$.

(d) 4-((2S,5S)-37-(2,5-dioxo-2,5-dihydro-1H-pyrrol-1-yl)-5-isopropyl-2-methyl-4,7,35-trioxo-10,13,16,19,22,25,28,31-octaoxa-3,6,34-triazaheptatriacontanamido)benzyl (3-(((S)-8-((5-(((S)-7-methoxy-2-methyl-5-oxo-5,11a-dihydro-1H-benzo[e]pyrrolo[1,2-a][1,4]diazepin-8-yl)oxy)pentyl)oxy)-2-methyl-5-oxo-5,11a-dihydro-1H-benzo[e]pyrrolo[1,2-a][1,4]diazepin-7-yl)oxy)propyl)carbamate (4)

1-ethyl-3-(3'-dimethylaminopropyl)carbodiimide (EDCl, 15 mg, 0.080 mmol, 1.1 eq) was added to a solution of crude 3 (0.077 mmol) and Mal-(PEG)$_8$-acid (48 mg, 0.080 mmol, 1.1 eq) in dry dichloromethane (2 mL). The reaction was degassed three times with Argon and stirred for 2 hours and the presence of starting material was no longer observed by LC/MS. The reaction was diluted with dichloromethane and washed sequentially with water and brine. The organic phase was dried over magnesium sulphate filtered and excess dichloromethane removed by rotary evaporation under reduced pressure. The resulting residue was subjected to flash column chromatography (silica gel; 100% chloroform to 10% methanol in chloroform). Pure fractions were collected and combined and excess eluent was removed by rotary evaporation under reduced pressure to give the desired product (40 mg). This residue was then purified further by preparative HPLC (3.7 mg, 31% over 2 steps). LC/MS 1.40 min, (ES+) m/z (relative intensity) 1521.95 [M+H]$^+$. $^1$H NMR (400 MHz, CDCl$_3$) δ 8.72 (s, 1H), 7.83 (s, 1H), 7.80 (d, J=3.9 Hz, 1H), 7.63-7.61 (m, 2H), 7.47 (d, J=8.3 Hz, 2H), 7.26 (br, 2H), 6.77-6.75 (m, 4H), 6.69 (s, 2H), 5.02 (s, 2H), 4.64-4.62 (m, 4H), 4.24-4.21 (m, 4H), 4.19-3.95 (m, 4H), 3.89 (s, 2H), 3.86-3.75 (m, 4H), 3.63 (br, 32H), 3.53-3.33 (m, 8H), 3.18-3.14 (m, 2H), 2.98-2.94 (m, 2H), 2.53-5.49 (m, 3H), 2.03 (s, 2H), 1.83 (br, 10H), 1.56 (br, 2H), 1.42 (s, 3H), 1.05-0.90 (m, 6H).

Example 2

General Antibody Conjugation Procedure

Antibodies are diluted to 1-5 mg/mL in a reduction buffer (examples: phosphate buffered saline PBS, histidine buffer, sodium borate buffer, TRIS buffer). A freshly prepared solution of TCEP (tris(2-carboxyethyl)phosphine hydrochloride) is added to selectively reduce cysteine disulfide bridges. The amount of TCEP is proportional to the target level of reduction, within 1 to 4 molar equivalents per antibody, generating 2 to 8 reactive thiols. After reduction for several hours at 37° C., the mixture is cooled down to room temperature and excess drug-linker can be added as a diluted DMSO solution (final DMSO content of up to 10% volume/volume of reaction mixture). The mixture is gently shaken at either 4° C. or room temperature for the appropriate time, generally 1-3 hours. Excess reactive thiols can be reacted with a 'thiol capping reagent' like N-ethyl maleimide (NEM) at the end of the conjugation. Antibody-drug conjugates may be concentrated using centrifugal spin-filters with a molecular weight cut-off of 10 kDa or higher, then purified by tangential flow filtration (TFF) or Fast Protein Liquid Chromatography (FPLC). Corresponding antibody-drug conjugates may be determined by analysis by High-Performance Liquid Chromatography (HPLC) or Ultra-High-Performance Liquid Chromatography (UHPLC) to assess drug-per-antibody ratio (DAR) using reverse-phase chromatography (RP) or Hydrophobic-Interaction Chromatography (HIC), coupled with UV-Visible, Fluorescence or Mass-Spectrometer detection; aggregate level and monomer purity can be analysed by HPLC or UHPLC using size-exclusion chromatography coupled with UV-Visible, Fluorescence or Mass-Spectrometer detection. Final conjugate concentration can be determined by a combination of spectroscopic (absorbance at 280, 214 and 330 nm) and biochemical assay (bicinchonic acid assay BCA; Smith, P. K., et al. (1985) *Anal. Biochem.* 150 (1): 76-85; using a known-concentration IgG antibody as reference). Antibody-drug conjugates are generally sterile filtered using 0.2 μm filters under aseptic conditions, and stored at +4° C., −20° C. or −80° C.

Conjugate A (Herceptin-4, ConjA)

Herceptin™ (3.5 mg, 23.3 nanomoles) was diluted into 3.15 mL of a reduction buffer containing 10 mM sodium borate pH 8.4, 2.5 mM EDTA and a final antibody concentration of 1.11 mg/mL. A 10 mM solution of TCEP was added (1.65 molar equivalent/antibody, 38.5 nanomoles, 3.85 μL) and the reduction mixture was heated at +37° C. for 1.5 hours in an incubator. After cooling down to room temperature, compound 4 was added as a DMSO solution (25 molar equivalent/antibody, 583 nanomoles, in 0.35 mL DMSO). The solution was mixed for 1.5 hours at room temperature, then the conjugation was quenched by addition of N-acetyl cysteine (1.6 micromole, 116.7 μL at 10 mM), then injected into an AKTA™ Pure FPLC using a GE Healthcare HiLoad™ 26/600 column packed with Superdex 200 PG, eluting with 2.6 mL/min of sterile-filtered phosphate-buffered saline (PBS). Fractions corresponding to ConjA monomer peak were pooled, concentrated using a 15 mL Amicon Ultracell 50 KDa MWCO spin filter, analysed and sterile-filtered.

UHPLC analysis on a Shimadzu Prominence system using a Phenomenex Aeris 3.6u XB-C18 150×2.1 mm column eluting with a gradient of water and acetonitrile on a reduced sample of ConjA at 280 nm and 330 nm (Compound 4 specific) shows a mixture of light and heavy chains attached to several molecules of compound 4, consistent with a drug-per-antibody ratio (DAR) of 2.14 molecules of compound 4 per antibody.

UHPLC analysis on a Shimadzu Prominence system using a Tosoh Bioscience TSKgel G3000SWXL 5 μm 7.8× 300 mm column (with a 7 μm 6.0×40 mm guard column) eluting with sterile-filtered SEC buffer containing 200 mM potassium phosphate pH 6.95, 250 mM potassium chloride and 10% isopropanol (v/v) on a sample of ConjA at 280 nm shows a monomer purity of over 99% with no impurity detected. UHPLC SEC analysis gives a concentration of final ConjA at 0.77 mg/mL in 3.2 mL, obtained mass of ConjA is 2.47 mg (71% yield).

Example 3: In Vivo ADC Efficacy Studies

CB.17 SCID mice, aged 8-12 weeks, may be injected with 1 $mm^3$ tumour fragments sub cutaneously in the flank. When tumours reach an average size of 100-150 mg, treatment may be begun. Mice may be weighed twice a week. Tumour size may be measured twice a week. Animals may be monitored individually. The endpoint of the experiment is a tumour volume of 1000 $mm^3$ or 60 days, whichever comes first. Responders can be followed longer.

Groups of 10 xenografted mice can be injected i.v. with 0.2 ml of antibody drug conjugate (ADC), or naked antibody, in phosphate buffered saline (vehicle) or with 0.2 ml of vehicle alone. The concentration of ADC can be adjusted to give, for example, 0.3 or 1.0 mg ADC/kg body weight in a single dose. Three identical doses may be given to each mouse at intervals of, for example, 1 week.

Example 4: In Vitro ADC Efficacy Studies

Medium from subconfluent (about 80-90% confluency) SK-BR-3 cells in a T75 flask was aspirated and PBS (about 20 ml) was added to rinse away the culture medium. The PBS was aspirated and Trypsin-EDTA (5 ml) added. The flask was returned to the 37° C. gassed incubator for up to about 5 minutes. The flask was rapped sharply to dislodge and dissociate cells from the plastic. The cell suspension was transferred to a sterile 50 ml screw-top centrifuge tube. Medium (McCoy's+10% FCS) was added to a final volume of 15 ml, then the tube was centrifuged (400 g for 5 min). The supernatant was aspirated and the pellet re-suspended in 10 ml culture medium. Repeated aspiration (up and down a 10 ml pipette) may be necessary to break up cell clumps and produce monodisperse cell suspensions suitable for counting. Cell suspension (10 μl) was mixed with Trypan blue (10 μl) and live/dead cells counted with a haemocytometer to determine cell concentration and viability. The cell suspension was diluted to 20×$10^4$/ml and 50 μl was dispensed into clear 96 well flat bottomed plates. The cells were incubated overnight to allow recovery before use.

A stock solution (1 ml) of antibody drug conjugate (ADC) (20 μg/ml) was made by dilution of filter-sterilised ADC into cell culture medium. A set of 8×10-fold dilutions of stock ADC was made in a 24 well plate by serial transfer of 100 μl onto 900 μl of cell culture medium. 50 μl of each ADC dilution is dispensed into 4 replicate wells of the 96 well plate, containing 50 μl cell suspension seeded the previous day. Control wells receive 50 μl cell culture medium. The 96-well plate containing cells and ADCs was incubated at 37° C. in a $CO_2$-gassed incubator for 4 days. At the end of the incubation period, viable cells were measured by MTS assay. MTS (Promega) was dispensed (20 μl per well) into each well and incubated for 4 hours at 37° C. in the $CO_2$-gassed incubator. Well absorbance was measured at 490 nm. Percentage cell survival is calculated from the mean absorbance in the 4 ADC-treated wells compared to the mean absorbance in the 4 control wells (100%).

| ADC | $EC_{50}$ (μg/ml) |
|---|---|
| ConjA | 0.00257 |

Abbreviations

Ac acetyl
Acm acetamidomethyl
Alloc allyloxycarbonyl
Boc di-tert-butyl dicarbonate
t-Bu tert-butyl
Bzl benzyl, where Bzl-OMe is methoxybenzyl and Bzl-Me is methylbenzene
Cbz or Z benzyloxy-carbonyl, where Z—Cl and Z—Br are chloro- and bromobenzyloxy carbonyl respectively
DMF N,N-dimethylformamide
Dnp dinitrophenyl
DTT dithiothreitol
Fmoc 9H-fluoren-9-ylmethoxycarbonyl
imp N-10 imine protecting group: 3-(2-methoxyethoxy)propanoate-Val-Ala-PAB
MC-OSu maleimidocaproyl-O—N-succinimide
Moc methoxycarbonyl
MP maleimidopropanamide
Mtr 4-methoxy-2,3,6-trimethtylbenzenesulfonyl
PAB para-aminobenzyloxycarbonyl
PEG ethyleneoxy
PNZ p-nitrobenzyl carbamate
Psec 2-(phenylsulfonyl)ethoxycarbonyl
TBDMS tert-butyldimethylsilyl
TBDPS tert-butyldiphenylsilyl
Teoc 2-(trimethylsilyl)ethoxycarbonyl
Tos tosyl
Troc 2,2,2-trichlorethoxycarbonyl chloride
Trt trityl
Xan xanthyl

REFERENCES

The following references are incorporated by reference in their entirety:
EP 0522868
EP 0875569
EP 1295944
EP 1347046
EP 1394274
EP 1394274
EP 1439393
JP 05003790
JP 2004113151
JP 58180487
US 2001/055751
US 2002/034749
US 2002/042366
US 2002/150573
US 2002/193567
US 2003/0228319
US 2003/060612
US 2003/064397
US 2003/065143
US 2003/091580
US 2003/096961
US 2003/105292
US 2003/109676
US 2003/118592
US 2003/119121
US 2003/119122
US 2003/119125
US 2003/119126
US 2003/119128
US 2003/119129
US 2003/119130
US 2003/119131
US 2003/124140
US 2003/124579
US 2003/129192
US 2003/134790-A1
US 2003/143557
US 2003/157089
US 2003/165504
US 2003/185830
US 2003/186372
US 2003/186373
US 2003/194704
US 2003/206918
US 2003/219806
US 2003/224411
US 2003/224454
US 2003/232056
US 2003/232350
US 20030096743
US 20030130189
US 2003096743
US 2003130189
US 2004/0001827
US 2004/005320
US 2004/005538
US 2004/005563
US 2004/005598
US 2004/0101899
US 2004/018553
US 2004/022727
US 2004/044179
US 2004/044180
US 2004/101874
US 2004/197325
US 2004/249130
US 20040018194
US 20040052793
US 20040052793
US 20040121940
US 2005/271615
US 2006/116422
U.S. Pat. No. 4,816,567
U.S. Pat. No. 5,362,852
U.S. Pat. No. 5,440,021
U.S. Pat. No. 5,583,024
U.S. Pat. No. 5,621,002
U.S. Pat. No. 5,644,033
U.S. Pat. No. 5,674,713
U.S. Pat. No. 5,700,670
U.S. Pat. No. 5,773,223
U.S. Pat. No. 5,792,616
U.S. Pat. No. 5,854,399
U.S. Pat. No. 5,869,445

U.S. Pat. No. 5,976,551
U.S. Pat. No. 6,011,146
U.S. Pat. No. 6,153,408
U.S. Pat. No. 6,214,345
U.S. Pat. No. 6,218,519
U.S. Pat. No. 6,268,488
U.S. Pat. No. 6,518,404
U.S. Pat. No. 6,534,482
U.S. Pat. No. 6,555,339
U.S. Pat. No. 6,602,677
U.S. Pat. No. 6,677,435
U.S. Pat. No. 6,759,509
U.S. Pat. No. 6,835,807
U.S. Pat. No. 7,223,837
U.S. Pat. No. 7,375,078
U.S. Pat. No. 7,521,541
U.S. Pat. No. 7,723,485
WO 00/012508
WO 00/12507
WO 00/12508
WO 01/16318
WO 01/45746
WO 02/088172
WO 03/026577
WO 03/043583
WO 04/032828
WO 2000/12130
WO 2000/14228
WO 2000/20579
WO 2000/22129
WO 2000/32752
WO 2000/36107
WO 2000/40614
WO 2000/44899
WO 2000/55351
WO 2000/75655
WO 200053216
WO 2001/00244
WO 2001/38490
WO 2001/40269
WO 2001/40309
WO 2001/41787
WO 2001/46232
WO 2001/46261
WO 2001/48204
WO 2001/53463
WO 2001/57188
WO 2001/62794
WO 2001/66689
WO 2001/72830
WO 2001/72962
WO 2001/75177
WO 2001/77172
WO 2001/88133
WO 2001/90304
WO 2001/94641
WO 2001/98351
WO 2002/02587
WO 2002/02624
WO 2002/06317
WO 2002/06339
WO 2002/101075
WO 2002/10187
WO 2002/102235
WO 2002/10382
WO 2002/12341
WO 2002/13847
WO 2002/14503
WO 2002/16413
WO 2002/16429
WO 2002/22153
WO 2002/22636
WO 2002/22660
WO 2002/22808
WO 2002/24909
WO 2002/26822
WO 2002/30268
WO 2002/38766
WO 2002/54940
WO 2002/59377
WO 2002/60317
WO 2002/61087;
WO 2002/64798
WO 2002/71928
WO 2002/72596
WO 2002/78524
WO 2002/81646
WO 2002/83866
WO 2002/86443
WO 2002/88170
WO 2002/89747
WO 2002/92836
WO 2002/94852
WO 2002/98358
WO 2002/99074
WO 2002/99122
WO 2003/000842
WO 2003/002717
WO 2003/003906
WO 2003/003984
WO 2003/004989
WO 2003/008537
WO 2003/009814
WO 2003/014294
WO 2003/016475
WO 2003/016494
WO 2003/018621
WO 2003/022995
WO 2003/023013
WO 2003/024392
WO 2003/025138
WO 2003/025148
WO 2003/025228
WO 2003/026493
WO 2003/029262
WO 2003/029277
WO 2003/029421
WO 2003/034984
WO 2003/035846
WO 2003/042661
WO 2003/045422
WO 2003/048202
WO 2003/054152
WO 2003/055439
WO 2003/055443
WO 2003/062401
WO 2003/062401
WO 2003/072035
WO 2003/072036
WO 2003/077836
WO 2003/081210
WO 2003/083041
WO 2003/083047
WO 2003/083074

WO 2003/087306
WO 2003/087768
WO 2003/088808
WO 2003/089624
WO 2003/089904
WO 2003/093444
WO 2003/097803
WO 2003/101283
WO 2003/101400
WO 2003/104270
WO 2003/104275
WO 2003/105758
WO 2003004529
WO 2003042661
WO 2003104399
WO 2004/000997
WO 2004/001004
WO 2004/009622
WO 2004/011611
WO 2004/015426
WO 2004/016225
WO 2004/020595
WO 2004/022709
WO 2004/022778
WO 2004/027049
WO 2004/031238
WO 2004/032828
WO 2004/032842
WO 2004/040000
WO 2004/043361
WO 2004/043963
WO 2004/044178
WO 2004/045516
WO 2004/045520
WO 2004/045553
WO 2004/046342
WO 2004/047749
WO 2004/048938
WO 2004/053079
WO 2004/063355
WO 2004/063362
WO 2004/063709
WO 2004/065577
WO 2004/074320
WO 2004000221
WO 2004020583
WO 2004042346
WO 2004065576
WO 2005/023814
WO 2005/082023
WO 2005/085251
WO 2006/111759
WO 2007/044515
WO 2007/085930
WO 2009/052249
WO 2010/091150
WO 91/02536
WO 92/07574
WO 92/17497
WO 94/10312
WO 94/28931
WO 9630514
WO 97/07198
WO 97/44452
WO 98/13059
WO 98/37193
WO 98/40403
WO 98/51805
WO 98/51824
WO 99/28468
WO 99/46284
WO 99/58658
Am. J. Hum. Genet. 49 (3):555-565 (1991)
Amiel J., et al Hum. Mol. Genet. 5, 355-357, 1996
Amir et al (2003) Angew. Chem. Int. Ed. 42:4494-4499
Amsberry, et al (1990) J. Org. Chem. 55:5867
Angew Chem. Intl. Ed. Engl. (1994) 33:183-186
Annu. Rev. Neurosci. 21:309-345 (1998)
Arai H., et al J. Biol. Chem. 268, 3463-3470, 1993
Arai H., et al Jpn. Circ. J. 56, 1303-1307, 1992
Arima, et al., J. Antibiotics, 25, 437-444 (1972)
Attie T., et al, Hum. Mol. Genet. 4, 2407-2409, 1995
Auricchio A., et al Hum. Mol. Genet. 5:351-354, 1996
Barel M., et al Mol. Immunol. 35, 1025-1031, 1998
Barella et al (1995) Biochem. J. 309:773-779
Barnett T., et al Genomics 3, 59-66, 1988
Beck et al (1992) J. Mol. Biol. 228:433-441
Beck et al (1996) J. Mol. Biol. 255:1-13
Berge, et al., J. Pharm. Sci., 66, 1-19 (1977)
Biochem. Biophys. Res. Commun. (2000) 275(3):783-788
Biochem. Biophys. Res. Commun. 255 (2), 283-288 (1999)
Blood (2002) 100 (9):3068-3076
Blood 99 (8):2662-2669 (2002)
Blumberg H., et al Cell 104, 9-19, 2001
Bose, et al., Tetrahedron, 48, 751-758 (1992)
Bourgeois C., et al J. Clin. Endocrinol. Metab. 82, 3116-3123, 1997
Brinster et al (1988) Proc. Natl. Acad. Sci. USA 85:836
Buchman and Berg (1988) Mol. Cell. Biol. 8:4395
Cancer Res. 61 (15), 5857-5860 (2001)
Carl et al (1981) J. Med. Chem. 24:479-480
Carlsson et al (1978) Biochem. J. 173:723-737
Carter, P. (2006) Nature Reviews Immunology 6:343-357
Cell 109 (3):397-407 (2002)
CellTiter Glo Luminescent Cell Viability Assay, Promega Corp. Technical Bulletin TB288
Chakravarty et al (1983) J. Med. Chem. 26:638-644
Chan, J. and Watt, V. M., Oncogene 6 (6), 1057-1061 (1991)
Child et al (1999) J. Biol. Chem. 274: 24335-24341
Cho H.-S., et al Nature 421, 756-760, 2003
Ciccodicola, A., et al EMBO J. 8(7):1987-1991 (1989)
Clackson et al (1991) Nature, 352:624-628
Clark H. F., et al Genome Res. 13, 2265-2270, 2003
Corey E, Quinn J E, Buhler K R, et al. LuCap35: a new model of prostate cancer progression to androgen independence. The Prostate 2003; 55:239-46
Coussens L., et al Science (1985) 230(4730):1132-1139
Cree et al (1995) AntiCancer Drugs 6:398-404
Crouch et al (1993) J. Immunol. Meth. 160:81-88
Davis et al (2001) Proc. Natl. Acad. Sci USA 98(17):9772-9777
de Groot et al (2001) J. Org. Chem. 66:8815-8830
de Groot et al (2003) Angew. Chem. Int. Ed. 42:4490-4494
Dennis et al. (2002) "Albumin Binding As A General Strategy For Improving The Pharmacokinetics Of Proteins" J Biol Chem. 277:35035-35043
Dobner et al (1992) Eur. J. Immunol. 22:2795-2799
Dornan et al (2009) Blood 114(13):2721-2729
Doronina et al (2006) Bioconj. Chem. 17:114-124
Dubowchik et al. Bioconjugate Chemistry, 2002, 13, 855-869
Dubowchik, et al. (1997) Tetrahedron Letters, 38:5257-60
Dumoutier L., et al J. Immunol. 167, 3545-3549, 2001

E. Schröder and K. Lübke, The Peptides, volume 1, pp 76-136 (1965) Academic Press
Ehsani A., et al (1993) Genomics 15, 426-429
Eliel, E. and Wilen, S., "Stereochemistry of Organic Compounds", John Wiley & Sons, Inc., New York, 1994
Elshourbagy N. A., et al J. Biol. Chem. 268, 3873-3879, 1993
Erickson et al (2006) Cancer Res. 66(8):1-8
Feild, J. A., et al (1999) Biochem. Biophys. Res. Commun. 258 (3):578-582
Fields, G. and Noble, R. (1990) "Solid phase peptide synthesis utilizing 9-fluoroenylmethoxycarbonyl amino acids", Int. J. Peptide Protein Res. 35:161-214
Fuchs S., et al Mol. Med. 7, 115-124, 2001
Fujisaku et al (1989) J. Biol. Chem. 264 (4):2118-2125)
Gary S. C., et al Gene 256, 139-147, 2000
Gaugitsch, H. W., et al (1992) J. Biol. Chem. 267 (16): 11267-11273)
Geiser et al "Automation of solid-phase peptide synthesis" in Macromolecular Sequencing and Synthesis, Alan R. Liss, Inc., 1988, pp. 199-218
Genome Res. 13 (10):2265-2270 (2003)
Genomics 62 (2):281-284 (1999)
Geoghegan & Stroh, (1992) Bioconjugate Chem. 3:138-146
Getz et al (1999) Anal. Biochem. Vol 273:73-80
Glynne-Jones et al (2001) Int J Cancer. October 15; 94(2): 178-84
Gregson et al., Chem. Commun. 1999, 797-798
Gregson et al., J. Med. Chem. 2001, 44, 1161-1174
Gu Z., et al Oncogene 19, 1288-1296, 2000
Ha et al (1992) J. Immunol. 148(5):1526-1531
Haendler B., et al J. Cardiovasc. Pharmacol. 20, s1-S4, 1992
Hamann P. (2005) Expert Opin. Ther. Patents 15(9):1087-1103
Hamblett et al (2004) Clin. Cancer Res. 10:7063-7070
Handbook of Pharmaceutical Additives, 2nd Edition (eds. M. Ash and I. Ash), 2001 (Synapse Information Resources, Inc., Endicott, N.Y., USA)
Handbook of Pharmaceutical Excipients, 2nd edition, 1994
Hara, et al., J. Antibiotics, 41, 702-704 (1988)
Hashimoto et al (1994) Immunogenetics 40(4):287-295
Hay et al. (1999) Bioorg. Med. Chem. Lett. 9:2237
Herdwijn, P. et al., Canadian Journal of Chemistry. 1982, 60, 2903-7
Hermanson, G. T. (1996) Bioconjugate Techniques; Academic Press: New York, p 234-242
Hochlowski, et al., J. Antibiotics, 40, 145-148 (1987)
Hofstra R. M. W., et al Eur. J. Hum. Genet. 5, 180-185, 1997
Hofstra R. M. W., et al Nat. Genet. 12, 445-447, 1996
Horie et al (2000) Genomics 67:146-152
Hubert, R. S., et al (1999) Proc. Natl. Acad. Sci. U.S.A. 96 (25):14523-14528)
Hurley and Needham-VanDevanter, Acc. Chem. Res., 19, 230-237 (1986)
Immunogenetics 54 (2):87-95 (2002)
Int. Rev. Cytol. 196:177-244 (2000)
Itoh, et al., J. Antibiotics, 41, 1281-1284 (1988)
J. Biol. Chem. 270 (37):21984-21990 (1995)
J. Biol. Chem. 276 (29):27371-27375 (2001)
J. Biol. Chem. 277 (22):19665-19672 (2002)
J. Biol. Chem. 278 (33):30813-30820 (2003)
Janeway, C., Travers, P., Walport, M., Shlomchik (2001) Immuno Biology, 5th Ed., Garland Publishing, New York
Jeffrey et al (2005) J. Med. Chem. 48:1344-1358
Jonsson et al (1989) Immunogenetics 29(6):411-413
Junutula, et al., 2008b Nature Biotech., 26(8):925-932
Kang, G-D., et al., Chem. Commun., 2003, 1680-1689
Kasahara et al (1989) Immunogenetics 30(1):66-68
King et al (2002) Tetrahedron Letters 43:1987-1990
Kingsbury et al (1984) J. Med. Chem. 27:1447
Kohler et al (1975) Nature 256:495
Kohn, in Antibiotics Ill. Springer-Verlag, New York, pp. 3-11 (1975).
Konishi, et al., J. Antibiotics, 37, 200-206 (1984)
Kovtun et al (2006) Cancer Res. 66(6):3214-3121
Kuhns J. J., et al J. Biol. Chem. 274, 36422-36427, 1999
Kuminoto, et al., J. Antibiotics, 33, 665-667 (1980)
Kurebayashi et al (1999) Brit. Jour. Cancer 79(5-6):707-717
Lab. Invest. 82 (11):1573-1582 (2002)
Lambert J. (2005) Current Opin. in Pharmacol. 5:543-549
Langley and Thurston, J. Org. Chem., 52, 91-97 (1987)
Larhammar et al (1985) J. Biol. Chem. 260(26):14111-14119
Law et al (2006) Cancer Res. 66(4):2328-2337
Le et al (1997) FEBS Lett. 418(1-2):195-199
Leber, et al., J. Am. Chem. Soc., 110, 2992-2993 (1988)
Leimgruber, et al., J. Am. Chem. Soc., 87, 5791-5793 (1965)
Leimgruber, et al., J. Am. Chem. Soc., 87, 5793-5795 (1965)
Levenson et al (1997) Cancer Res. 57(15):3071-3078
Liang et al (2000) Cancer Res. 60:4907-12
Manfre, F. et al., J. Org. Chem. 1992, 57, 2060-2065
Marks et al (1991) J. Mol. Biol., 222:581-597
McDonagh (2006) Protein Eng. Design & Sel., 19(7): 299-307
Mendoza et al (2002) Cancer Res. 62:5485-5488
Miller et al (2003) Jour. of Immunology 170:4854-4861
Miura et al (1996) Genomics 38(3):299-304
Miura et al (1998) Blood 92:2815-2822
Moore M., et al Proc. Natl. Acad. Sci. U.S.A. 84, 9194-9198, 1987
Morrison et al (1984) Proc. Natl. Acad. Sci. USA, 81:6851-6855
Muller et al (1992) Eur. J. Immunol. 22 (6):1621-1625
Mungall A. J., et al Nature 425, 805-811, 2003
Nagase T., et al (2000) DNA Res. 7 (2):143-150)
Nakamuta M., et al Biochem. Biophys. Res. Commun. 177, 34-39, 1991
Nakayama al (2000) Biochem. Biophys. Res. Commun. 277(1):124-127
Naruse et al (2002) Tissue Antigens 59:512-519
Nature 395 (6699):288-291 (1998)
Neuberger and Williams (1988) Nucleic Acids Res. 16:6713
Novabiochem Catalog 2006/2007
Ogawa Y., et al Biochem. Biophys. Res. Commun. 178, 248-255, 1991
Okamoto Y., et al Biol. Chem. 272, 21589-21596, 1997
Oncogene 10 (5):897-905 (1995)
Oncogene 14(11):1377-1382 (1997))
Parrish-Novak J., et al J. Biol. Chem. 277, 47517-47523, 2002
Payne, G. (2003) Cancer Cell 3:207-212
Phillips et al (2008) Cancer Res. 68(22):9280-9290
Pingault V., et al (2002) Hum. Genet. 111, 198-206
Pletnev S., et al (2003) Biochemistry 42:12617-12624
Preud'homme et al (1992) Clin. Exp. Immunol. 90(1):141-146
Proc. Natl. Acad. Sci. U.S.A. (2003) 100 (7):4126-4131
Proc. Natl. Acad. Sci. 93 (1):136-140 (1996)
Proc. Natl. Acad. Sci. U.S.A. 98 (17):9772-9777 (2001)
Proc. Natl. Acad. Sci. U.S.A. 99 (26):16899-16903 (2002)
Proc. Natl. Acad. Sci. U.S.A. 96 (20):11531-11536 (1999)

Protective Groups in Organic Synthesis, Greene and Wuts, 3rd Edition, 1999, John Wiley & Sons Inc.
Puffenberger E. G., et al Cell 79, 1257-1266, 1994
Rao et al (1997) Breast Cancer Res. and Treatment 45:149-158
Reiter R. E., et al Proc. Natl. Acad. Sci. U.S.A. 95, 1735-1740, 1998
Remington's Pharmaceutical Sciences, 20th edition, pub. Lippincott, Williams & Wilkins, 2000
Rodrigues et al (1995) Chemistry Biology 2:223
Ross et al (2002) Cancer Res. 62:2546-2553
S. P. Parker, Ed., McGraw-Hill Dictionary of Chemical Terms (1984) McGraw-Hill Book Company, New York
Sakaguchi et al (1988) EMBO J. 7(11):3457-3464
Sakamoto A., Yanagisawa M., et al Biochem. Biophys. Res. Commun. 178, 656-663, 1991
Sanderson et al (2005) Clin. Cancer Res. 11:843-852
Semba K., et al Proc. Natl. Acad. Sci. U.S.A. 82, 6497-6501, 1985
Servenius et al (1987) J. Biol. Chem. 262:8759-8766
Shamis et al (2004) J. Am. Chem. Soc. 126:1726-1731
Sheikh F., et al (2004) J. Immunol. 172, 2006-2010
Shimizu, et al, J. Antibiotics, 29, 2492-2503 (1982)
Sinha S. K., et al (1993) J. Immunol. 150, 5311-5320
Storm et al (1972) J. Amer. Chem. Soc. 94:5815
Strausberg et al (2002) Proc. Natl. Acad. Sci USA 99:16899-16903
Sun et al (2002) Bioorganic & Medicinal Chemistry Letters 12:2213-2215
Sun et al (2003) Bioorganic & Medicinal Chemistry 11:1761-1768
Svensson P. J., et al Hum. Genet. 103, 145-148, 1998
Swiercz J. M., et al J. Cell Biol. 165, 869-880, 2004
Syrigos and Epenetos (1999) Anticancer Research 19:605-614
Takeuchi, et al., J. Antibiotics, 29, 93-96 (1976)
Tawaragi Y., et al Biochem. Biophys. Res. Commun. 150, 89-96, 1988
ten Dijke, P., et al Science 264 (5155):101-104 (1994)
Thompson, J. S., et al Science 293 (5537), 2108-2111 (2001)
WO 2004/058309
Thurston, et al., Chem. Brit., 26, 767-772 (1990)
Thurston, et al., Chem. Rev. 1994, 433-465 (1994)
Toki et al (2002) J. Org. Chem. 67:1866-1872
Tonnelle et al (1985) EMBO J. 4(11):2839-2847
Touchman et al (2000) Genome Res. 10:165-173
Trail et al (2003) Cancer Immunol. Immunother. 52:328-337
Tsunakawa, et al., J. Antibiotics, 41, 1366-1373 (1988)
Tsutsumi M., et al Gene 228, 43-49, 1999
Uchida et al (1999) Biochem. Biophys. Res. Commun. 266:593-602
Verheij J. B., et al Am. J. Med. Genet. 108, 223-225, 2002
Von Hoegen et al (1990) J. Immunol. 144(12):4870-4877
Webster et al (1994) Semin. Cancer Biol. 5:69-76
Weis J. J., et al J. Exp. Med. 167, 1047-1066, 1988
Weis J. J., et al Proc. Natl. Acad. Sci. U.S.A. 83, 5639-5643, 1986
Wilson et al (1991) J. Exp. Med. 173:137-146
Wu et al (2005) Nature Biotech. 23(9):1137-1145
Xie et al (2006) Expert. Opin. Biol. Ther. 6(3):281-291
Xu, M. J., et al (2001) Biochem. Biophys. Res. Commun. 280 (3):768-775 WO 2004/016225
Xu, X. Z., et al Proc. Natl. Acad. Sci. U.S.A. 98 (19):10692-10697 (2001)
Yamaguchi, N., et al Biol. Chem. 269 (2), 805-808 (1994)
Yamamoto T., et al Nature 319, 230-234, 1986
Yu et al (1992) J. Immunol. 148(2) 633-637

SEQUENCE LISTING (233 sequences)

SEQ ID NO: 1 - protein, 21 aa, Artificial sequence
  Synthetic sequence: A20FMDV-Cys polypeptide
NAVPNLRGDLQVLAQKVARTC

SEQ ID NO: 2 - protein, 21 aa, Artificial sequence
  Synthetic sequence: A20FMDV-Cys polypeptide
  VARIANT (4)..(18): Xaa is any amino acid residue
NAVXXXXXXXXXXXXXXXRTC

SEQ ID NO: 3 - protein, 137 aa, Artificial sequence
  Synthetic sequence: Anti-Integrin Alpha v Beta 6,  RHAB6.2
QVQLVQSGSELKKPGASVKISCKASGFAFTDSYMHWVRQAPGQGLEWMGWIDPENGDTEYAPKFQGRFVFSLDTSVSTAYLQISSLKAEDTAVYYCTRGTPTAVPNLRGDLQVLAQKVAGPYPFDYWGQGTLVTVSS

SEQ ID NO: 4 - protein, 137 aa, Artificial sequence
  Synthetic sequence: Anti-Integrin Alpha v Beta 6, RHCB6.2
QVQLVQSGAEVKKPGASVKVSCKASGYTFIDSYMHWVRQAPGQRLEWMGWIDPENGDTEYAPKFQGRVTITTDTSASTAYMELSSLRSEDTAVYYCARGTPTAVPNLRGDLQVLAQKVAGPYPFDYWGQGTLVTVSS

SEQ ID NO: 5 - protein, 120 aa, Artificial sequence
  Synthetic sequence: Anti-Integrin Alpha v Beta 6, RHF
QVQLVQSGAEVKKPGASVKVSCKASGFNFIDSYMHWVRQAPGQRLEWMGWIDPENGDTEYAPKFQGRVTFTTDTSASTAYMELSSLRSEDTAVYYCNEGTPTGPYYFDYWGQGTLVTVSS

SEQ ID NO: 6 - protein, 137 aa, Artificial sequence
  Synthetic sequence: Anti-Integrin Alpha v Beta 6, RHFB6
QVQLVQSGAEVKKPGASVKVSCKASGFNFIDSYMHWVRQAPGQRLEWMGWIDPENGDTEYAPKFQGRVTFTTDTSASTAYMELSSLRSEDTAVYYCNEGTPTAVPNLRGDLQVLAQKVAGPYYFDYWGQGTLVTVSS

SEQ ID NO: 7 - protein, 120 aa, Artificial sequence
  Synthetic sequence: Anti-Integrin Alpha v Beta 6, RHAY100bP
QVQLVQSGSELKKPGASVKISCKASGFAFTDSYMHWVRQAPGQGLEWMGWIDPENGDTEYAPKFQGRFVFSLDTSVSTAYLQISSLKAEDTAVYYCTRGTPTGPYPFDYWGQGTLVTVSS

SEQ ID NO: 8 - protein, 106 aa, Artificial sequence
  Synthetic sequence: Anti-Integrin Alpha v Beta 6, RKF
ENVLTQSPGTLSLSPGERATLSCSASSSVSYMHWFQQKPGQAPRLLIYSTSNLASGIPDRFSGSGSGTDFTLTISRLEPEDFAVYYCQQRSSYPLTFGGGTKVEIK

SEQ ID NO: 9 - protein, 106 aa, Artificial sequence
  Synthetic sequence: Anti-Integrin Alpha v Beta 6, RKFL36L50
ENVLTQSPGTLSLSPGERATLSCSASSSVSYMHWLQQKPGQAPRLLIYLTSNLASGIPDRFSGSGSGTDFTLTISRLEPEDFAVYYCQQRSSYPLTFGGGTKVEIK

SEQ ID NO: 10 - protein, 106 aa, Artificial sequence
  Synthetic sequence: Anti-Integrin Alpha v Beta 6, RKC
EIVLTQSPGTLSLSPGERATLSCSASSSVSYMHWFQQKPGQAPRLLIYSTSNLASGIPDRFSGSGSGTDFTLTISRLEPEDFAVYYCQQRSSYPLTFGGGTKVEIK

SEQ ID NO: 11 - protein, 116 aa, Artificial sequence
  Synthetic sequence: Anti-CD33, CD33 Hum195 VH
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSS

SEQ ID NO: 12 - protein, 111 aa, Artificial sequence
  Synthetic sequence: Anti-CD33, CD33 Hum195 VK
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIK

SEQ ID NO: 13 - protein, 120 aa, Artificial sequence
  Synthetic sequence: Anti-CD19, CD19 B4 resurfaced VH
QVQLVQPGAEVVKPGASVKLSCKTSGYTFTSNWMHWVKQRPGQGLEWIGEIDPSDSYTNYNQNFKGKAKLTVDKSTSTAYMEVSSLRSDDTAVYYCARGSNPYYYAMDYWGQGTSVTVSS

SEQ ID NO: 14 - protein, 104 aa, Artificial sequence
  Synthetic sequence: Anti-CD19, CD19 B4 resurfaced VK
EIVLTQSPAIMSASPGERVTMTCSASSGVNYMHWYQQKPGTSPRRWIYDTSKLASGVPARFSGSGSGTSYSLTISSMEPEDAATYYCHQRGSYTFGGGTKLEIK

SEQ ID NO: 15 - protein, 120 aa, Artificial sequence [sequence omitted]

SEQ ID NO: 16 - protein, 107 aa, Artificial sequence [sequence omitted]

SEQ ID NO: 17 - protein, 104 aa, Artificial sequence [sequence omitted]

SEQ ID NO: 18 - protein, 115 aa, Artificial sequence
  Synthetic sequence: Anti-CD25, Simulect VH
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSS

SEQ ID NO: 19 - protein, 115 aa, Artificial sequence
  Synthetic sequence: Anti-PSMA, Deimmunised VH '1
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 20 - protein, 107 aa, Artificial sequence
  Synthetic sequence: Anti-PSMA, Deimmunised VK '1
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 21 - protein, 116 aa, Artificial sequence
  Synthetic sequence: Anti-PSMA, Deimmunised VH1 '5
EVKLVESGGGLVQPGGSMKLSCVASGFTFSNYWMNWVRQAPGKGLEWVAEIRSQSNNFATHYAESVKGRVTISRDDSKSIVYLQMNNLRAEDTGVYYCTRRWNNFWGQGTTVTVSS

SEQ ID NO: 22 - protein, 116 aa, Artificial sequence
  Synthetic sequence: Anti-PSMA, Deimmunised VH2 '5
EVKLVESGGGLVQPGGSLKLSCVASGFTFSNYWMNWVRQAPGKGLEWVAEIRSQSNNFATHYAESVKGRVTISRDDSKSIVYLQMNNLRAEDTAVYYCTRRWNNFWGQGTTVTVSS

SEQ ID NO: 23 - protein, 116 aa, Artificial sequence
  Synthetic sequence: Anti-PSMA, Deimmunised VH3 '5
EVQLVESGGGLVQPGGSLKLSCVASGFTFSNYWMNWVRQAPGKGLEWVAEIRSQSNNFATHYAESVKGRVTISRDDSKSIVYLQMNNLRAEDTAVYYCTRRWNNFWGQGTTVTVSS

SEQ ID NO: 24 - protein, 116 aa, Artificial sequence
  Synthetic sequence: Anti-PSMA, Deimmunised VH4 '5
EVQLVESGGGLVQPGGSLKLSCVASGFTFSNYWMNWVRQAPGKGLEWVAEIRSQSNNFATHYAESVKGRFTISRDDSKSIVYLQMNNLRAEDTAVYYCTRRWNNFWGQGTTVTVSS

SEQ ID NO: 25 - protein, 107 aa, Artificial sequence
  Synthetic sequence: Anti-PSMA, Deimmunised VK1 '5
NIVMTQFPSSMSASVGDRVTITCKASENVGTYVSWYQQKPDQSPKMLIYGASNRFTGVPDRFTGSGSATDFTLTISSLQTEDLADYYCGQSYTFPYTFGQGTKLEMK

SEQ ID NO: 26 - protein, 107 aa, Artificial sequence
  Synthetic sequence: Anti-PSMA, Deimmunised VK2 '5
NIVMTQFPSSMSASVGDRVTITCKASENVGTYVSWYQQKPDQSPKMLIYGASNRFTGVPDRFSGSGSGTDFTLTISSLQAEDLADYYCGQSYTFPYTFGQGTKLEIK

SEQ ID NO: 27 - protein, 107 aa, Artificial sequence
  Synthetic sequence: Anti-PSMA, Deimmunised VK3 '5
NIQMTQFPSAMSASVGDRVTITCKASENVGTYVSWYQQKPDQSPKMLIYGASNRFTGVPDRFSGSGSGTDFTLTISSLQAEDLADYYCGQSYTFPYTFGQGTKLEIK

SEQ ID NO: 28 - protein, 107 aa, Artificial sequence
  Synthetic sequence: Anti-PSMA, Deimmunised VK4 '5
NIQMTQFPSAMSASVGDRVTITCKASENVGTYVSWYQQKPDQSPKMLIYGASNRFTGVPDRFSGSGSGTDFTLTISSLQAEDEADYYCGQSYTFPYTFGQGTKLEIK

SEQ ID NO: 29 - protein, 107 aa, Artificial sequence
  Synthetic sequence: Anti-PSMA, Deimmunised VK DI '5
NIVMTQFPKSMSASAGERMTLTCKASENVGTYVSWYQQKPTQSPKMLIYGASNRFTGVPDRFSGSGSGTDFILTISSVQAEDLVDYYCGQSYTFPYTFGGGTKLEMK

SEQ ID NO: 30 - protein, 116 aa, Artificial sequence
  Synthetic sequence: Anti-PSMA, Deimmunised VH DI '5
EVKLEESGGGLVQPGGSMKISCVASGFTFSNYWMNWVRQSPEKGLEWVAEIRSQSNNFATHYAESVKGRVIISRDDSKSSVYLQMNSLRAEDTAVYYCTRRWNNFWGQGTTVTVSS

SEQ ID NO: 31 - protein, 116 aa, Artificial sequence
  Synthetic sequence: Anti-PSMA, Humanised RHA '5
EVQLVESGGGLVQPGGSLKLSCAASGFTFSNYWMNWVRQASGKGLEWVGEIRSQSNNFATHYAESVKGRFTISRDDSKNTAYLQMNSLKTEDTAVYYCTRRWNNFWGQGTTVTVSS

SEQ ID NO: 32 - protein, 116 aa, Artificial sequence
  Synthetic sequence: Anti-PSMA, Humanised RHB '5
EVKLVESGGGLVQPGGSLKLSCAASGFTFSNYWMNWVRQASGKGLEWVAEIRSQSNNFATHYAESVKGRVIISRDDSKNTVYLQMNSLRTEDTAVYYCTRRWNNFWGQGTTVTVSS

SEQ ID NO: 33 - protein, 116 aa, Artificial sequence
  Synthetic sequence: Anti-PSMA, Humanised RHC '5
EVQLVESGGGLVQPGGSLKLSCAASGFTFSNYWMNWVRQASGKGLEWVAEIRSQSNNFATHYAESVKGRVIISRDDSKNTVYLQMNSLRTEDTAVYYCTRRWNNFWGQGTTVTVSS

SEQ ID NO: 34 - protein, 116 aa, Artificial sequence
  Synthetic sequence: Anti-PSMA, Humanised RHD '5
EVKLVESGGGLVQPGGSLKLSCAASGFTFSNYWMNWVRQASGKGLEWVGEIRSQSNNFATHYAESVKGRVIISRDDSKNTVYLQMNSLRTEDTAVYYCTRRWNNFWGQGTTVTVSS

SEQ ID NO: 35 - protein, 116 aa, Artificial sequence
  Synthetic sequence: Anti-PSMA, Humanised RHE '5
EVKLVESGGGLVQPGGSLKLSCAASGFTFSNYWMNWVRQASGKGLEWVAEIRSQSNNFATHYAESVKGRFTISRDDSKNTVYLQMNSLRTEDTAVYYCTRRWNNFWGQGTTVTVSS

SEQ ID NO: 36 - protein, 116 aa, Artificial sequence
  Synthetic sequence: Anti-PSMA, Humanised RHF '5
EVKLVESGGGLVQPGGSLKLSCAASGFTFSNYWMNWVRQASGKGLEWVAEIRSQSNNFATHYAESVKGRVIISRDDSKNTAYLQMNSLRTEDTAVYYCTRRWNNFWGQGTTVTVSS

SEQ ID NO: 37 - protein, 116 aa, Artificial sequence; identical to SEQ ID NO: 36
  Synthetic sequence: Anti-PSMA, Humanised RHG '5

SEQ ID NO: 38 - protein, 107 aa, Artificial sequence
  Synthetic sequence: Anti-PSMA, Humanised RKA '5
DIQMTQSPSSVSASVGDRVTITCKASENVGTYVSWYQQKPGTAPKLLIYGASNRFTGVPSRFSGSGSATDFTLTINNLQPEDFATYYCGQSYTFPYTFGQGTKVEIK

SEQ ID NO: 39 - protein, 107 aa, Artificial sequence; identical to SEQ ID NO: 38
  Synthetic sequence: Anti-PSMA, Humanised RKB '5

SEQ ID NO: 40 - protein, 107 aa, Artificial sequence
  Synthetic sequence: Anti-PSMA, Humanised RKC '5
DIQMTQSPSSVSASVGDRVTITCKASENVGTYVSWYQQKPGTAPKMLIYGASNRFTGVPSRFSGSGSATDFTLTINNLQPEDFATYYCGQSYTFPYTFGQGTKVEIK

SEQ ID NO: 41 - protein, 107 aa, Artificial sequence; identical to SEQ ID NO: 40
  Synthetic sequence: Anti-PSMA, Humanised RKD '5

SEQ ID NO: 42 - protein, 107 aa, Artificial sequence
  Synthetic sequence: Anti-PSMA, Humanised RKE '5
NIVMTQSPSSVSASVGDRVTITCKASENVGTYVSWYQQKPGTAPKLLIYGASNRFTGVPDRFTGSGSATDFILTINNLQPEDFATYYCGQSYTFPYTFGQGTKVEIK

SEQ ID NO: 43 - protein, 107 aa, Artificial sequence
  Synthetic sequence: Anti-PSMA, Humanised RKF '5
NIVMTQSPSSVSASVGDRVTITCKASENVGTYVSWYQQKPGTAPKMLIYGASNRFTGVPSRFSGSGSATDFILTINNLQPEDFATYYCGQSYTFPYTFGQGTKVEIK

SEQ ID NO: 44 - protein, 107 aa, Artificial sequence
  Synthetic sequence: Anti-PSMA, Humanised RKG '5
NIVMTQSPSSVSASVGDRVTITCKASENVGTYVSWYQQKPGTAPKMLIYGASNRFTGVPDRFTGSGSATDFTLTINNLQPEDFATYYCGQSYTFPYTFGQGTKVEIK

SEQ ID NO: 45 - DNA, 5560 bp, Homo sapiens
cgcggggcgcggagtcggcggggcctcgcgggacgccgggcagtgcggagaccgcggcgctgaggacgcgggagccgggagcgcagccgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagcttttttttttttttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagataggaaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttggaaaaaaaca

SEQ ID NO: 46 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 47 - DNA, 4543 bp, Homo sapiens
cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 48 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 49 - DNA, 1330 bp, Homo sapiens
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaaaaaaaaaaaaaaaaa

SEQ ID NO: 50 - protein, 339 aa, Homo sapiens
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 51 - DNA, 21112 bp, Homo sapiens
cctgtgacttctcttctcacccctggcctggtgataaccacagacaggatgggcataagcagagaacctggaaccagttccacttcaaatttgagcagcacctcccatgagagactgaccactttggaagacactgtagatacagaagccatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcgtctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagtgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccattcaactgcatctcaaggattttcacactcacagatgaccgctcttatgagtagaactcctggagaggtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacggtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggaggataccactgttttcacatcaaatcctgccttctctgagactaggaggattccgacagagccaacattctcattgactcctggattcagggagactagcacctctgaagagaccacctcaatcacagaaacaagtgcagtcctttttggagtgcccactagtgctactactgaagtctccatgacagaaataatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggacttaggaagaccaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctggcacagacagaaatatgactattccaactttgactctttctcctggtgaaccaaagaccatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcattctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctttctggtcactagttctagagcagtaaccagtacaactattccaactctgactatttcttctgatgaaccagagaccacaacttcattggtcacccattctgaggcaaagatgatttcagccattccaactttaggtgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacatacaagttcagccattccaactctccctgtctcccctgatgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttcaaggaagttcaacgccacagagagagaactgcagggtctgctcaaacccttgttcaggaatagcagtctggaatacctctattcaggctgcagactagcctcactcaggccagagaaggatagctcagccacggcagtggatgccatctgcacacatcgccctgaccctgaagacctcggactggacagagagcgactgtactgggagctgagcaatctgacaaatggcatccaggagctgggcccttacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagccattgttcaagaacaccagtgttggccctttgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagaccctggttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcagctatactgggagctgagccaactgaccaatggcatcaaagagctgggcccctacaccctggacaggaacagtctctatgtcaatggtttcacccattggatccctgtgcccaccagcagcacccctgggacctccacagtggaccttgggtcagggactccatcctccctccccagccccacaagtgctactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaaaaaaaaaaaaaaaaaaaaaaaa

SEQ ID NO: 52 - protein, 6995 aa, Homo sapiens
PVTSLLTPGLVITTDRMGISREPGTSSTSNLSSTSHERLTTLEDTVDTEAMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGEVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPRSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVEDTTVFTSNPAFSETRRIPTEPTFSLTPGFRETSTSEETTSITETSAVLFGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGLRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHSAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTFLVTSSRAVTSTTIPTLTISSDEPETTTSLVTHSEAKMISAIPTLGVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPDASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLVGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTSATAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 53 - DNA, 2187 bp, Homo sapiens
tgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaaaaaaaaaaaaaaaa

SEQ ID NO: 54 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 55 - DNA, 4167 bp, Homo sapiens
accttcgccatatatacccggggcgctgcgctccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaaaaaaaaaaaaaaaa

SEQ ID NO: 56 - protein, 690 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 57 - DNA, 4559 bp, Homo sapiens
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggacctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaactggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccacaggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 58 - protein, 1202 aa, Homo sapiens
AAAPFPDRPPAHLVSSRRSAPPGSREPRGTGHLHPPLGVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEDLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATGCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 59 - DNA, 1524 bp, Homo sapiens
gcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagaga

SEQ ID NO: 60 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 61 - DNA, 1329 bp, Homo sapiens
atgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 62 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 63 - DNA, 4573 bp, Homo sapiens
agaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 64 - protein, 783 aa, Homo sapiens
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 65 - DNA, 6857 bp, Homo sapiens
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaactgttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccaaaagctaaaacgaattaaaaaaggctgggaaaagagccaatttctggaagaaggtattggaggaacaattcctcatgtctccccggagagggtcacagtaatgtgatgataaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcctccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcatgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccctacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 66 - protein, 490 aa, Homo sapiens
MESISMMGSPKSLSETVLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISQKLKRIKKGWEKSQFLEEGIGGTIPHVSPERVTVM

SEQ ID NO: 67 - DNA, 4103 bp, Homo sapiens
aggctggaaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtgaaaaaaa

SEQ ID NO: 68 - protein, 1214 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 69 - DNA, 2174 bp, Homo sapiens
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 70 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 71 - DNA, 3934 bp, Homo sapiens
gccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacagggatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatgaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttactgtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaa

SEQ ID NO: 72 - protein, 1033 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCMKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 73 - DNA, 1300 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacaaaaaaaaaaaaaaaaaaaaaaaaaaaaaaaaaaaaaaaa

SEQ ID NO: 74 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 75 - DNA, 2592 bp, Homo sapiens
agagtctccagttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctataaaa

SEQ ID NO: 76 - protein, 508 aa, Homo sapiens
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 77 - DNA, 4530 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcgtctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagacgaaataaagacccaggggagaatgggtgttgtatggggaggcaagtgtggggggtccttctccacacccactttgtccatttgcaaatatattttggaaaac

SEQ ID NO: 78 - protein, 1255 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIVSAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERAKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 79 - DNA, 2533 bp, Homo sapiens
ggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccattcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 80 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 81 - DNA, 1583 bp, Homo sapiens
gtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaaaaaaaaaaaaaaaaa

SEQ ID NO: 82 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 83 - DNA, 3485 bp, Homo sapiens
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatgacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 84 - protein, 553 aa, Homo sapiens [sequence omitted]

SEQ ID NO: 85 - DNA, 2558 bp, Homo sapiens
tgtggcactgcctgcgtacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaattgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgc

SEQ ID NO: 86 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 87 - DNA, 4869 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 88 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 89 - DNA, 1658 bp, Homo sapiens
ggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggggacaccgattttataaataaactgagcaccttctttttaaacaaaaaaaaaaaaaaaaaaaaaaaaaaaaaaaaaaaaaaaaaaaaaaaaaaaa

SEQ ID NO: 90 - DNA, 946 bp, Homo sapiens
tgacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtttgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagca

SEQ ID NO: 91 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 92 - DNA, 1852 bp, Homo sapiens
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactca

SEQ ID NO: 93 - protein, 236 aa, Homo sapiens
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 94 - DNA, 1052 bp, Homo sapiens
tgccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaata

SEQ ID NO: 95 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 96 - DNA, 2544 bp, Homo sapiens
agatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcaataaagaatcttacttaagccaggtgcggtggctcacgcctgtcatctcagcactttgggaggccaaggcgggaggatcacttgaggtcaggagttcgagaccagcctggccagcatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccaccctcaagccatgacatgaattggggattatctggttaggtctttttgttcccctcttggtggggatttttttcgcatcattatcttgtgcctcattcattcaataaatacgtatcatgaacctactaggtaccaggccctattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaaaaaaaaaaaaaaaa

SEQ ID NO: 97 - protein, 240 aa, Homo sapiens
MLPGSLKREDTRKQVKIILLLFCIQQASYYGTAVMGQAYLPELGTQWGPPWLSLTGVTTGCRQTPVLSILLARPAESSESRVGYWMPRREEGAREVSPKVLQGPQQAWTEEVWTAWPCPEPLCIITAVPNLHPTLSLPIPGPGALLLCSRDSWSSLRQHTVLLWRRPSPTHAGMLQPVPEQVVAGGCWQRRDNGPAPGGKCWLQGTESSPCHSPCYPLGNLKGISKNSGSATLLSFLWNM

SEQ ID NO: 98 - DNA, 2116 bp, Homo sapiens
acgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagttttccccagac

SEQ ID NO: 99 - protein, 647 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGTMRTSFQIFQKMRGFITQS

SEQ ID NO: 100 - DNA, 1258 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 101 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 102 - DNA, 2919 bp, Homo sapiens
aaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtaaaaaaaaaaaaaaaaa

SEQ ID NO: 103 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 104 - DNA, 1388 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtaaaaaaaaaaaaaaaaa

SEQ ID NO: 105 - protein, 273 aa, Homo sapiens
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 106 - DNA, 2341 bp, Homo sapiens
tccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaaaaaaaaaaaaaaaaaaaaaaaaaaaaaaaaaa

SEQ ID NO: 107 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 108 - DNA, 1548 bp, Homo sapiens
aattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 109 - protein, 359 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 110 - DNA, 2725 bp, Homo sapiens
agaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacgatcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagaccgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaaaaaaaaaaa

SEQ ID NO: 111 - protein, 661 aa, Homo sapiens
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTIFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 112 - DNA, 3116 bp, Homo sapiens
aacttccgatatcaacttcctcaaacctctgatgagctgctgctgctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtcttcaatgtctctcaggtaaggctgtatcaatttatatcttcaccaacaacgtctgggaaatcagtttgtggggtgtattacttagttttcacattgctaataaagacatatccaagactgggtaatttataaaaaaaaaaaaaaaaaaaa

SEQ ID NO: 113 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 114 - DNA, 2797 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacg

SEQ ID NO: 115 - protein, 759 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 116 - DNA, 1814 bp, Homo sapiens
gcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaaa

SEQ ID NO: 117 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 118 - DNA, 2653 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 119 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 120 - DNA, 2996 bp, Homo sapiens
cgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctcaaaaaaaaaaaaaaaaaaaaaaaaaaaaaaaaaa

SEQ ID NO: 121 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 122 - DNA, 1245 bp, Homo sapiens
cgtcctcccttcttctcttgcagagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccgcccgcgcaccgcgccgcagccaacgggcttatgcagaccagcaagctgtgagagtgcaggcggggggtgggcggccccgtgtcacccccaggagcggaggttgcactgcggtgacccccacccatgacctgccagtcaggatgctccccgg

SEQ ID NO: 123 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 124 - DNA, 5717 bp, Homo sapiens
ggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcattttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagcaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagcaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatct

SEQ ID NO: 125 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 126 - DNA, 2397 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 127 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 128 - DNA, 3036 bp, Homo sapiens
cgaccagcagaccagacagtcacagcagccttgacaaaacgttcctggaactcaagcacttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccatgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtat

SEQ ID NO: 129 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 130 - DNA, 90 bp, Homo sapiens
ttggctttggtcttcaagtagccaaagcgatgaaatatcttgcaagcaaaaagtttgtccacagagacttggctgcaagaaactgtatgt

SEQ ID NO: 131 - protein, 22 aa, Homo sapiens
KAMKYLASKKFVHRDLAARNCM

SEQ ID NO: 132 - DNA, 1804 bp, Homo sapiens
cgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacaccgtccttcagaggccccaccaatttctcggacacttctcagtgtgtggaagctcatgtgggcccctgaggctcatgcctgggaagtgttgtggtgggggctcccaggaggactggcccagagagccctgagatagcggggatcctgaactggactgaataaaacgtggtctcccactg

SEQ ID NO: 133 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 134 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 135 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 136 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 137 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 138 - DNA, 1437 bp, Homo sapiens
gcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaaccttacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggactggttcatggggccattggaggagctggtgttacagccctgctcgctctttgtctctgcctcatcttcttcatagtgaagacccacaggaggaaagcagccaggacagcagtgggcagcaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 139 - protein, 364 aa, Homo sapiens
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGLVHGAIGGAGVTALLALCLCLIFFIVKTHRRKAARTAVGSNDTHPTTGSASPKHQKNSKLHGPTETSSCSGAAPTVEMDEELHYASLNFHGMNPSKDTSTEYSEVRTQ

SEQ ID NO: 140 - DNA, 1968 bp, Homo sapiens
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcctaaaaaaaaaaa

SEQ ID NO: 141 - protein, 557 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 142 - DNA, 3216 bp, Homo sapiens
ggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatatttttt

SEQ ID NO: 143 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 144 - DNA, 3227 bp, Homo sapiens
gctgggcaaagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctaagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccacttttccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcaaaaaaaaaaaaaaaaaaaaa

SEQ ID NO: 145 - protein, 885 aa, Homo sapiens [sequence omitted]

SEQ ID NO: 146 - DNA, 3630 bp, Homo sapiens
atacgggagaactaaggctgaaacctcggaggaacaaccacttttgaagtgacttcgcggcgtgcgttgggtgcggactaggtggccccggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacagcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttaaaaaaaa

SEQ ID NO: 147 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 148 - DNA, 3802 bp, Homo sapiens
  misc_feature (1064)..(1065): n is a, c, g, or t
  misc_feature (1240)..(1240): n is a, c, g, or t
  misc_feature (1862)..(1862): n is a, c, g, or t
  misc_feature (1878)..(1878): n is a, c, g, or t
  misc_feature (1899)..(1900): n is a, c, g, or t
  misc_feature (1906)..(1906): n is a, c, g, or t
  misc_feature (1917)..(1917): n is a, c, g, or t
  misc_feature (1928)..(1929): n is a, c, g, or t
  misc_feature (2395)..(2395): n is a, c, g, or t
cccctgcagctggcctcaatgttaagatcttaaggggcacagcacagaccttgtcttgtctatctccctggcacctctcacagagtacagcttattaacagatgttccagaaactgttactgaacaatcggcttgatgctgtgggcttgtctgcatcttgcaactgtcacctggctgagaaatttcttctataaataagcagtttctgtttcagatgtgatatgccctgatatttacaccctgtctcttaccccatccaagactcaaacttagaaacttgaattagatgtggtattcaaatccttacgtgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattatttttagcaaaataatcaagtatgacagccgggtgcggtggatggctcacacctgtaatcccagcactttgggaggccgagatgggtgaatcacctgaggtcggcagtttgagnncagcctggccaacctggtgaaaccctgtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcaactctagcctnggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggttggtttgatggtgaatctttgaaatctatttccaggggatggctattgtgagtttcagttccttttctttttttagcgttgactatttcacttcgttacagccctttcgaatgtgttagaacattgttacattaaatgaacttggtagaggtgagccatcttcattctgattttgacaccttggcagattttctacaatgtcagtcttctccaggattcttccactgttaattactctattgaaagtactaaggctttcttgggaaacatcagtctctttgactaaagttagcacatcgattaaatgccacattatcagaaactcctagccaggtctgctactgtcaggaaaagcatatttgtcnagatctatggtcakgnttttatacaaatataggtgtnnyttgcntgagtgaacantttactactgnnaaaatgttagaaatgaataaccagttgctcctgaattatttgaggaatcatctaaaaaataattatttttaagcaatagagaaccagtcccagaaaaatgaatgttctacttaagtgcctcttaagataaaaaatacttctgcagcacctttgctcatgattggattcccaagcatgtacagccactgccctatttctgtatgcatttatttatttatttatttatttatttatttagagatggagtctcgctctgtggcccaaggctggagtgcagtggcgtgatctcaactcactgcagcctctgcctcttgggttcaaacaattctcccatctcagcctcctgagtaactggactataggtatgtgccatcacctccgactaatttttgtactttttggtagagacagggtttcatcatgttggccaggatggtctcaagctcctgaccacaagtgatctgcncgcctcagcttcccaaagtgctgggattacaggcgtgagccacagggcccagcacatactcattcttttttactgaaaagatctgtttcaagctgggtgttggtggctatggagctgtagtccgactgctctgtaggctaacgtgggaggattgcttgagcccagagtttgaatgcagcctgggcaacacagtaagaccccacctctaaaaaatgaaaaaatctctctcacattgctttgagtcccgatgtgtactgctaagactctcatgaccacattctctgtgaagtttgggttaagttccgttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaagtctttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtgctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacctgtaatcccagctactcaggaggctgaggcaggagaatcgcttgaacctgggaggtggaggttgcaatgagctgagatagcatccctgcactccagcctgggcaagagggtgagactccgtctcaaaacaaaacaacacaaacaaacaaaaagtacctccagcttcatcttctgctggattttatagcgcccccaaagatatgtggtccttaaaaattgtataccacttattcaggagtcttgttcctgaaagggttgttcttgttacagccctagtctgggctgtaatcagcttcttaaggtcc

SEQ ID NO: 149 - protein, 184 aa, Homo sapiens [sequence omitted]

SEQ ID NO: 150 - DNA, 2607 bp, Homo sapiens
tctgttcccacttcctccccgccccaggaaacctgccatggcctcctggtgagctgtcctcatccactgctcgctgcctctccagatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaaaaaaaaaaaaaaa

SEQ ID NO: 151 - protein, 361 aa, Homo sapiens
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 152 - DNA, 2371 bp, Homo sapiens
tctcctcttgctctaagcagggtgtttgaccttctagtcgactgcgtcccctgtacccggcgccagctgtgttcctgaccccagaataactcagggctgcaccgggcctggcagcgctccgcacacatttcctgtcgcggcctaagggaaactgttggccgctgggcccgcggggggattcttggcagttggggggtccgtcgggagcgagggcggaggggaagggagggggaaccgggttggggaagccagctgtagagggcggtgaccgcgctccagacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataacccagactcaaatatcattgccttcctccaggagtaattaggaacagctgagggcatgctgggagtaagcagcaagagtgcattctgcttttagattgagggagaggt

SEQ ID NO: 153 - protein, 490 aa, Homo sapiens
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 154 - DNA, 3973 bp, Homo sapiens
gggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaa

SEQ ID NO: 155 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 156 - DNA, 926 bp, Homo sapiens
ccagagaggggcaggcttgtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgtctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtttgtggcaggacaagagaaggcattgagctttttctttcattttcctattaaaaaatacaaaaatcaaaacaaaaaaaa

SEQ ID NO: 157 - protein, 193 aa, Homo sapiens [sequence omitted]

SEQ ID NO: 158 - protein, 293 aa, Artificial sequence
  Synthetic construct
MGILPFLLIPMESNWTVHVFSRTLCHMLLWTAVLNLAAGTHDLPKAVVKLEPPWIQVLKEDTVTLTCEGTHNPGNSSTQWFHNGRSIRSQVQASYTFKATVNDSGEYRCQMEQTRLSDPVDLGVISDWLLLQTPQLVFLEGETITLRCHSWRNKLLNRISFFHNEKSVRYHHYSSNFSIPKANHSHSGDYYCKGSLGRTQHQSKTVTITVQGPKSSRSLPVLTIVAAVTGIAVAAIVIILVSLVYLKKKQVPDNPPDLEEAAKTEAENTITYSLLKHPEALDEETEHDYQNHI

SEQ ID NO: 159 - DNA, 2880 bp, Homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 160 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 161 - DNA, 3977 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 162 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 163 - DNA, 3858 bp, Homo sapiens
ctactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaagaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgattttttctggagaattgtaaaataaagttttctatttttccttaaaaaaaaaaccggaattccgggcttgggaggctgaggcaggagactcgcttgaacccgggaggcagaggttgcagtgagccaagattgcgccattgcactccagagcctgggtgacagagcaagactacatctcaaaaaataaataaataaaataaaagtaacaataaaaataaaaagaacagcagagagaatgagcaaggagaaatgtcacaaactattgcaaaatactgttacactgggttggctctccaagaagatactggaatctcttcagccatttgcttttcagaagtagaaaccagcaaaccacctctaagcggagaacatacgattctttattaagtagctctggggaaggaaagaataaaagttgatagctccctgattgggaaaaaatgcacaattaataaagaatgaagatgaaagaaagcatgcttatgttgtaacacaaaaaaaattcacaaacgttggtggaaggaaaacagtatagaaaacattactttaactaaaagctggaaaaattttcagttgggatgcgactgacaaaaagaacgggatttccaggcataaagttggcgtgagctacagagggcaccatgtggctcagtggaagacccttcaagattcaaagttccatttgacagagcaaaggcacttcgcaaggagaagggtttaaattatgggtccaaaagccaagtggtaaagcgagcaatttgcagcataactgcttctcctagacagggctgagtgggcaaaatacgacagtacacacagtgactattagccactgccagaaacaggctgaacagccctgggagacaagggaaggcaggtggtgggagttgttcatggagagaaaggagagttttagaaccagcacatccactggagatgctgggccaccagacccctcccagtcaataaagtctggtgcctcatttgatctcagcctcatcatgaccctggagagaccctgataccatctgccagtccccgacagcttaggcactccttgccatcaacctgaccccccgagtggttctccaggctccctgccccacccattcaggccggaattc

SEQ ID NO: 164 - protein, 875 aa, Homo sapiens
MESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQKKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 165 - DNA, 585 bp, Homo sapiens
caacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaaaaaaaaaaaaaaaa

SEQ ID NO: 166 - protein, 134 aa, Homo sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 167 - DNA, 3850 bp, Homo sapiens
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcatcctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaaaaaaaa

SEQ ID NO: 168 - protein, 1073 aa, Homo sapiens
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 169 - DNA, 2744 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactttggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 170 - protein, 749 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 171 - DNA, 5551 bp, Homo sapiens
  misc_feature (1769)..(1769): n is a, c, g, or t
ttttcatggaaatatcttcaaatttcattagtggtcctattatagaagacacacagcaggcaagtgtcagagctagaaatgaccctaaatttctgggtccctattcagcagccataagcaattgccagctgcaggaaggtggaggcagaagaagtaaaaagggaacaagaggtgaggtttacgttctgcctaagtggaacagagtagaactttgcacaaactccttaatcttgcctagaggcagaatgtgggatgtactatatgggaggcaggcaaatctgggcctggttcccacctccatcactcatttgaacaagttatgtaatttatttttgcgtcaattttcttgtctgtaaaactggagtgagaggacctaacttgagtaccgaagtgaagagtcaatgagataatatctgtgatcagcacagtgcttggcaagtggaagacactcagtcaagctaacttaaagccccagttttttcatttgtacaacagaacaacaacaataatagcaacaagcaataatactaacaatatttatcttgcctctgagttgtcttgaaaatcagatgagtatatatattatgtttctaaattctaaagtgtatctcactctcctaacaaagcagttggtcttcagatcaggaccagagttaataccatgccagagcattattacaggttttttccaatgagtaattaattttatttttaaacttatcatacagtaaaattgactcttttggtttacaaagttctatgagttatagcacgttgtataggtttatgtaaccaccaccacaatccggatacagaacatgactacagctttagagattctttttcaaagtgttttacattcatgttgcaaaacacttttaaaaataagaaaagagatgtagataaacgtgctgaagatgcaaattaatgaaaccagcttttgtgcacaaatctctgcagtttccagtgttttcagcttttgtctgagccatttttgctgtcggctttgcagactatctctttctataaaagtaatcaggcgtccgttggagagttgggtctttcttcacattaaaggcacatgtcccaggcacaagcctcaggatccttatttgatcttttttaatacgaccaggtcttaaatttccgaaccatgttttccctaattgccattttctctctaaaatgaagaagcctggaagaaccttcttatcccttcggggaaattatttaattgggacaaaggggatgtggagttacagagagcaacgatagggctttcaggaacccaaaacctgtctggtataataacagatccttccggtaaccaaccattcaatttgtccctctcccccaaccccatcctctccatcaccatctgccagatggccccctgggaccaatcgactttgaaaccaaacttctctcccaggtcagctcctgcaatccccactcctcgtcccttggagctttctccacagaagtgacttgacacaccgcgctacatctggggaggggggcgggtccgctttccgggagactcaagtctttgctatttgccttttgtttctgggatgcctttggctgcctttctcttccatctgcttttaattttggtaagagaaaagctaatgaatcaggaatgaatctcctctccactaatctttwtgttttctttctctctctctctctcttagagttggcgcgctctcttcacgagttccatcactacccaagaagtgagggggcgggggggacaggcgggaagncattaattacacctaaatctgaagtttgcggcctcaagtaccactttgatggggagagcttctgaagcttccatacaacctgccgtgcctttgctgctgccgcagtagattttcagctcatttctttctgctgctgcttcgcgctgctctgtcatgcctaaatctatctcgtcactgccaaaggtgcctgaatcagggtgaattccacgagattcaccagcggttttgctccagtccaaggtaaatacagtatgcaaaatgaggaaccacccaaggatgtcggggaggggggagagaaagggattccctcaccttttccggcacattcctcgttaatttccaccaggaggaggcgcgcagcccagctcccctagtctctcttcttaaatccccctacctacggctgccgaggttggccgcgcgtcgggagtctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtgagcagtgggagcccgcggcctgggagagacccgggaggcgtcgttggggcccctccccatcctcgggtggagagtagggttggttcgggttgccactgtaccccgagtcccactgctgctttgttcccagactctcccctcctctttggagatgacttgaacccctttgagatccgaggggctggcggggcgcgggctggggggcgacagttgtagctccacttcctgctaatgcgagaaggtacaaaaagagatcaaaaagtcctgtaacctgaaacttccctcgcatcctaaccgggaccgggtggagaggtctgggcgggggcggagacacccggaggccgaccttccgccgaggcggtgcaggaaggaacgggagagggagaagtttggtagggaaggaattggggattaagcggtaagttagacgcgggagacgatctcctcgggaaaggcggagggcgggaggccggtcgggtttatttagtgtgggccagggaagaaggaagactttgcggtctgggtgtcggatgcgcgtccccctccggagtaaaagtgaccggaggggttggggaggcgaggccggggcgggcttttggaaggaggtctctgggacagactggagacgactagactcgaaaaggccggtttttgcactccggaagccgcggcagccaccgctgttcacgcctctctcctgcttgtcccaggtccctcagaggatccagcgaggggtgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaaataaacattgttaaaacaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgtttcgaaatgg

SEQ ID NO: 172 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 173 - DNA, 5977 bp, Homo sapiens
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaaaaaaaaaaaa

SEQ ID NO: 174 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 175 - DNA, 1108 bp, Homo sapiens
ctggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcac

SEQ ID NO: 176 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 177 - DNA, 2669 bp, Homo sapiens
cagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccatatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtatagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaaaaaaaaaaaaa

SEQ ID NO: 178 - protein, 560 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 179 - DNA, 1440 bp, Homo sapiens
gttacccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaacgacaactgttccaacaacaatgagcattccaacgacaacgactgttccgacgacaatgactgtttcaacgacaacgagcgttccaacgacaacgagcattccaacaacaacaagtgttccagtgacaacaacggtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgactgcagaagactgaacaggtatcagcacatcagatgtcttttagactccaagacaatttttctgtttcagtttcatctggcattccaacatgtcagtgatactgggtagagtaactctcccactccaaactgtgtatagtcaacctcatcattaatgtagtcctaatttgttttgctaaaactggctcaatccttctgatcattgcagagttttctctcaaacatgaacactttagaattgtatgttctctttagaccccataaatcctgtat

SEQ ID NO: 180 - protein, 359 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPTTTVPTTMSIPTTTTVPTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 181 - DNA, 2671 bp, Homo sapiens
ggtgagtcaccaaggaaggcagcggcagctccactcagccactgcaattgtgtccggaatttattccttctggtgggttcatggtcttgctgacttcaagaatgaagccgctgacctcgcgcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccggcccacagtggtctgggcatcccaagttgaccagggagccaacttctcggaagtctccaataccagctttgagctgaactctgagaatgtgaccatgaaggtagtgtctgtgctctacaatgttacgatcaacaacacatactcctgtatggttgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgccgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgccactaccaactagtggatagaggccagggatgctgctcaacctcctaccatgtacaggacgtctccccattacaactacccaatccgaagtgtcaactgtgtcagggctaaggaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacaaaaaaaaaaaaaaaaaaaaaaaaaaaaaaaaaataaaaaaaaaaaaaaaaaa

SEQ ID NO: 182 - DNA, 1164 bp, Homo sapiens
agtggggccaggggagtcatctttttccgttgcgggtacccacctgccgctggccagcattgccccagaggcatccttgggtggctgcttgtataaactgcaaggtccacaaagtgttgaacaagttgttgaatgttttggccaacactgcacctgctgtcttccctacagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgtttttgtttttttgtttttgtttttgtttttacactcgctgctctcaataaataagcctttttta

SEQ ID NO: 183 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 184 - DNA, 1229 bp, Homo sapiens
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaaaaaaaaaaaaaaaaaaaa

SEQ ID NO: 185 - protein, 213 aa, Homo sapiens
MGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 186 - DNA, 3148 bp, Homo sapiens
gtgggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggca

SEQ ID NO: 187 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 188 - DNA, 1506 bp, Homo sapiens
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 189 - protein, 232 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 190 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 191 - protein, 1210 aa, Homo sapiens [sequence omitted]

SEQ ID NO: 192 - DNA, 4975 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 193 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMGGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGGSCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 194 - DNA, 4541 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 195 - protein, 661 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAGSFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLQVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTN

SEQ ID NO: 196 - DNA, 3935 bp, Homo sapiens
aggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagaaaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaaaaaaaaaaaaa

SEQ ID NO: 197 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 198 - DNA, 1146 bp, Homo sapiens
cctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcttggcagcaacggagaaaaactctaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcc

SEQ ID NO: 199 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 200 - DNA, 8605 bp, Homo sapiens
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaaaaaaa

SEQ ID NO: 201 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 202 - DNA, 2814 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttcctacaaaatatgctctctggtggtctcctaatggaaaatttttggcatatgcggaatttaatgataaggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaagaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaaaaaaaaaaaaaaaaaaaaaaaaagcggccgctcg

SEQ ID NO: 203 - protein, 760 aa, Homo sapiens [sequence omitted]

SEQ ID NO: 204 - DNA, 1815 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 205 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 206 - DNA, 523 bp, Homo sapiens
ctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaaaaa

SEQ ID NO: 207 - protein, 61 aa, Homo sapiens
MKRFLFLLLTISLLVMVQIQTGLSGQNDTSQTSSPSASSNISGGIFLFFVANAIIHLFCFS

SEQ ID NO: 208 - DNA, 2672 bp, Homo sapiens
cttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatagaaatgtaaatgcaaggtcacacatattaatgacagcctgttgtattaatgatggctccaggtcagtgtctggagtttcattccatcccagggcttggatgtaaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcaaaaaaaaaaaaaaaa

SEQ ID NO: 209 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 210 - DNA, 3292 bp, Homo sapiens
ccgcggtggtcccaatctcttccttcctccatgaggtgtctggggtcggggccccagttcttcctggagtccatctggagtctctcctactttctagagaatccattgggtcttgtttacaacgtggatggggacagactgtgcagcgtggagggaaggggagggagggaggtttgggaagagcctcctgtggggtcctgtcactgccccagatgccccaacaccctgtgatacctgcacccctgccacatctgtccctcactccaaactcagctcaaggggatggtggcagggaagaaggtgagcttggaacccaggcagccctggggtcaccacctccagctggggttcctcctctgtaaagtggaggtataacggtacccacctcctggggtggctgtgaggattcagagctgataaggtgaacgcctagggcgggccctggtgcagagagagcgctcagctcctaggctggattaactgtccctggggcacagatctcggtctggggcctgtggaaacctcagagccacccctgaacccccaccgagccacctttgcctcgcagtgccatggcctcgtctccgagttacaggaaaaggcagagaatgcccttctcaggtggccctctgggagagacactctccttgactccaaagccacgcttggctgcaaactgggccagcaccacaaggctgggcaagcaaacatcctaatcccaccaaaaccacaccgacctccaccctgtgacactctgcaacaaacacacggcctactcttgtcacccgggccggccaataagcacggaagaggcaaggcctcagaccctggacagacatcctccctccagaggcacccagggcctcagccttctcctccctccctggcctcaatttctccacctgtgacccagggcaggtggatccagggagaagaaccttctggctccatctcaccgtgggtcctgccagcacacacaaagatttggcctctcaaagcctagctctgccagcgtccttctgctcaagaactctccatgactcccagtggccctaaggacaaagtcctggcatttgaggccctcccaatgcagggccagactctgcctctccagcttcctgtccccaccacacccctgctgtctcacggtggtccgactgtttcctgcttctgttgctttgcttagtctggcaccctgctggcatgctttctcacccttcttccccaatcccaactcacccagtctttcaaagggcaggctaaataccaggcctccaggtggcccaggattcttctctgagctttcatgggcctggccctgggtgctacctgtgagtagtcccacggtgggtacatagtaggtgcgcttactgtttgcaagaatgaacatgggacagtttggggactgtcacccagctcagggagcactgatggggaagcatctcctgtatgtcccagggctcagtgctgtagtgtcctgaccctcagaaatctcataatggcttggtcaggaaggcatcgtgccccactttgcaaacagggggtgctgagaattgaggggccttgtccaaggtctcatggctaggagcaagcagaatcggatttgaacccagggccacgtgacttcagaagtgccattaaagtccccataatttggagctgtcttctttttttttttcttttctttttttttgagaccgagcctcactctgtcacctaggccaggagtgcagtggtctgatctcagctcactgcaacctccgcctcctaggttcaagtgattctctagcctcagcctcccaagtagctgggactacaggcgcacgtcatcatgcccagctaacttttgtatttttagtagagatgggttttcaccatgttggtcaggctggtctcgaactcctgacctcaagtgatccgtctgcctcggcctctcaaagtgctgggattataaggcttgagccactacactcggcctggagctgtgttttgtcggtgaaggattttccacccatgaaggggtcagacgtgaagtgtgtggccctgggcagctcctctgagcccagagacgccagccctagccgccttgctgtgccactttgggacttccctccctagcctgagcttcagttttcctgcctgttaggcagccccatgtcaactgcacttagtaggccgggtttgatgcccgacaagacgtgaagtggtggaggtgggcaggatcccagcgctaccatcttcttgaaccagtgatctcaacacatcggatttctgtttcctcatctgcaaaatgggatcagtgagctcaggtgggtcacaaattctacaggaactactttagccaagcccggccccctgaaagttcccctcggtgggctgttagggtgattgttttcatctgtggggctcctgatgcgtcccacccaccagccttggagagggtgggatgggagggtggggtgcttggggagacaagcctagagcctgggcctcccaccccactgcctccccccatcccagggccccccacccagtgacaaagcccgtggcacttcctctacccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgaccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtaggtgtccagggacccagggtggggagactcggcctccggtgcacggaccaggccccaagtattcccggcctccttcctgtatcctgagctcacgcccagcagagccatccttggggctctggagggtcaccaaccctcccagtttgctggaactaaatggttatgcaggactttcagtgttgaaagaaagcctcgggcaaactgggctgactctttcactttaaccctggtctctggcgtctgctcacccagctg

SEQ ID NO: 211 - protein, 22 aa, Homo sapiens
MDRGTLPLAVALLLASCSLSPT

SEQ ID NO: 212 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 213 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 214 - DNA, 3080 bp, Homo sapiens
cactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattaaa

SEQ ID NO: 215 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 216 - protein, 5 aa, Artificial sequence
  Synthetic sequence: Heavy chain CDR1
DNYMH

SEQ ID NO: 217 - protein, 17 aa, Artificial sequence
  Synthetic sequence: Heavy chain CDR2
WIDPENGDTEYAPKFRG

SEQ ID NO: 218 - protein, 11 aa, Artificial sequence
  Synthetic sequence: Heavy chain CDR3
LIYAGYLAMDY

SEQ ID NO: 219 - protein, 10 aa, Artificial sequence
  Synthetic sequence: Light chain CDR1
SASSSVTYMH

SEQ ID NO: 220 - protein, 7 aa, Artificial sequence
  Synthetic sequence: Light chain CDR2
STSNLAS

SEQ ID NO: 221 - protein, 9 aa, Artificial sequence
  Synthetic sequence: Light chain CDR3
QQRSTYPLT

SEQ ID NO: 222 - protein, 11 aa, Artificial sequence
  Synthetic sequence: Light chain CDR1
KASQDVGTSVA

SEQ ID NO: 223 - protein, 7 aa, Artificial sequence
  Synthetic sequence: Light chain CDR2
WTSTRHT

SEQ ID NO: 224 - protein, 8 aa, Artificial sequence
  Synthetic sequence: Light chain CDR3
QQYSLYRS

SEQ ID NO: 225 - protein, 5 aa, Artificial sequence
  Synthetic sequence: Heavy chain CDR1
TYWMS

SEQ ID NO: 226 - protein, 17 aa, Artificial sequence
  Synthetic sequence: Heavy chain CDR2
EIHPDSSTINYAPSLKD

SEQ ID NO: 227 - protein, 10 aa, Artificial sequence
  Synthetic sequence: Heavy chain CDR3
LYFGFPWFAY

SEQ ID NO: 228 - protein, 15 aa, Artificial sequence
  Synthetic sequence: Light chain CDR1
KASQSVDYDGDSYLN

SEQ ID NO: 229 - protein, 7 aa, Artificial sequence
  Synthetic sequence: Light chain CDR2
DASNLVS

SEQ ID NO: 230 - protein, 9 aa, Artificial sequence
  Synthetic sequence: Light chain CDR3
QQSTEDPWT

SEQ ID NO: 231 - protein, 5 aa, Artificial sequence
  Synthetic sequence: Heavy chain CDR1
SYWMN

SEQ ID NO: 232 - protein, 17 aa, Artificial sequence
  Synthetic sequence: Heavy chain CDR2
QIWPGDGDTNYNGKFKG

SEQ ID NO: 233 - protein, 15 aa, Artificial sequence
  Synthetic sequence: Heavy chain CDR3
RETTTVGRYYYAMDY

The invention claimed is:

1. A conjugate of formula (A):

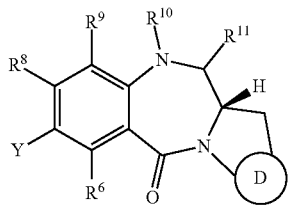

and salts and solvates thereof, wherein:

D represents either group D1 or D2:

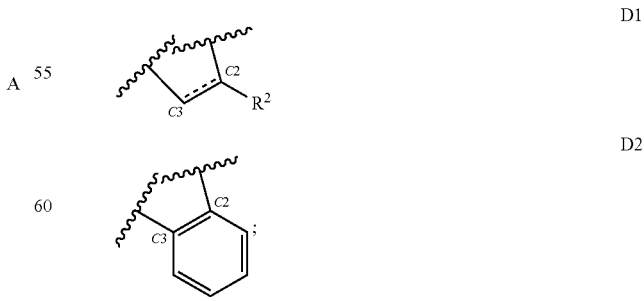

the dotted line indicates the optional presence of a double bond between C2 and C3;

when there is a double bond present between C2 and C3, $R^2$ is selected from the group consisting of:
(ia) $C_{5-10}$ aryl group, optionally substituted by one or more substituents selected from the group comprising: halo, nitro, cyano, ether, carboxy, ester, $C_{1-7}$ alkyl, $C_{3-7}$ heterocyclyl and bis-oxy-$C_{1-3}$ alkylene;
(ib) $C_{1-5}$ saturated aliphatic alkyl;
(ic) $C_{3-6}$ saturated cycloalkyl;
(id)

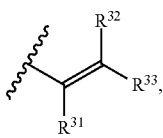

wherein each of $R^{31}$, $R^{32}$ and $R^{33}$ are independently selected from H, $C_{1-3}$ saturated alkyl, $C_{2-3}$ alkenyl, $C_{2-3}$ alkynyl and cyclopropyl, where the total number of carbon atoms in the $R^2$ group is no more than 5;
(ie)

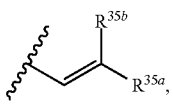

wherein one of $R^{35a}$ and $R^{35b}$ is H and the other is selected from: phenyl, which phenyl is optionally substituted by a group selected from halo, methyl, methoxy; pyridyl; and thiophenyl; and
(if)

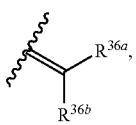

where $R^{34}$ is selected from: H; $C_{1-3}$ saturated alkyl; $C_{2-3}$ alkenyl; $C_{2-3}$ alkynyl; cyclopropyl; phenyl, which phenyl is optionally substituted by a group selected from halo, methyl, methoxy; pyridyl; and thiophenyl;
(ig) halo;
when there is a single bond present between C2 and C3, $R^2$ is

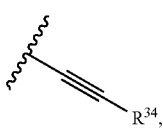

where $R^{36a}$ and $R^{36b}$ are independently selected from H, F, $C_{1-4}$ saturated alkyl, $C_{2-3}$ alkenyl, which alkyl and alkenyl groups are optionally substituted by a group selected from $C_{1-4}$ alkyl amido and $C_{1-4}$ alkyl ester; or, when one of $R^{16a}$ and $R^{16b}$ is H, the other is selected from nitrile and a $C_{1-4}$ alkyl ester;
$R^6$ and $R^9$ are independently selected from H, R, OH, OR, SH, SR, $NH_2$, NHR, NRR', $NO_2$, $SnMe_3$ and halo;

either
(a) $R^{10}$ is H, and $R^{11}$ is OH or $OR^A$, where $R^A$ is $C_{1-4}$ alkyl; or
(b) $R^{10}$ and $R^{11}$ form a nitrogen-carbon double bond between the nitrogen and carbon atoms to which they are bound; or
(c) $R^{10}$ is H and $R^{11}$ is $OSO_zM$, where z is 2 or 3 and M is a monovalent pharmaceutically acceptable cation; or
(d) $R^{11}$ is OH or $OR^A$, where $R^A$ is $C_{1-4}$ alkyl and $R^{10}$ is selected from:

(d-i)

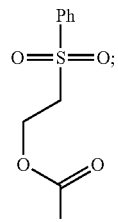

(d-ii)

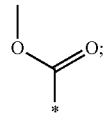

(d-iii)

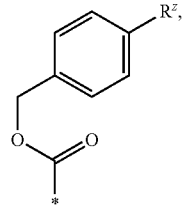

where $R^z$ is selected from:
(z-i)

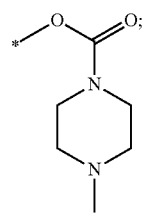

(z-ii) $OC(=O)CH_3$;
(z-iii) $NO_2$;
(z-iv) OMe;
(z-v) glucoronide;
(z-vi) $-C(=O)-X_1-NHC(=O)X_2-NH-R^{ZC}$, where $-C(=O)-X_1-NH-$ and $-C(=O)-X_2-NH-$ represent natural amino acid residues and $R^{zc}$ is selected from Me, OMe, $OCH_2CH_2OMe$;

Y is selected from formulae A1 and A2:

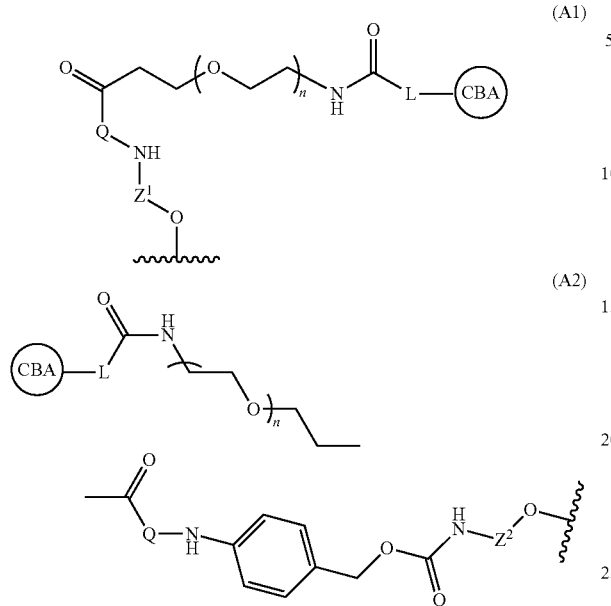

(A1)

(A2)

$Z^1$ is a $C_{1-3}$ alkylene group;
$Z^2$ is a $C_{1-3}$ alkylene group;
Q is:

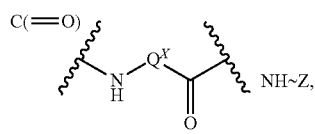

where $Q^X$ is such that Q is an amino-acid residue, a dipeptide residue or a tripeptide residue;
  L is a linker connected to a cell binding agent;
  CBA is the cell binding agent;
  n is an integer between 0 and 48;
  R and R' are each independently selected from optionally substituted $C_{1-12}$ alkyl, $C_{3-20}$ heterocyclyl and $C_{5-20}$ aryl groups, and optionally in relation to the group NRR', R and R' together with the nitrogen atom to which they are attached form an optionally substituted 4-, 5-, 6- or 7-membered heterocyclic ring;
  $R^8$ is either:
  (a) independently selected from H, R, OH, OR, SH, SR, $NH_2$, NHR, NRR', $NO_2$, $SnMe_3$ and halo; or
  (b) of formula A*:

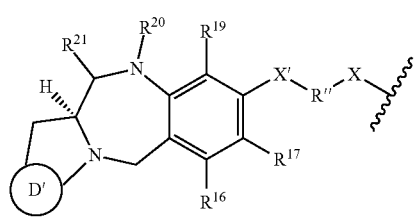

A* wherein:
  D' represents either group D'1 or D2:

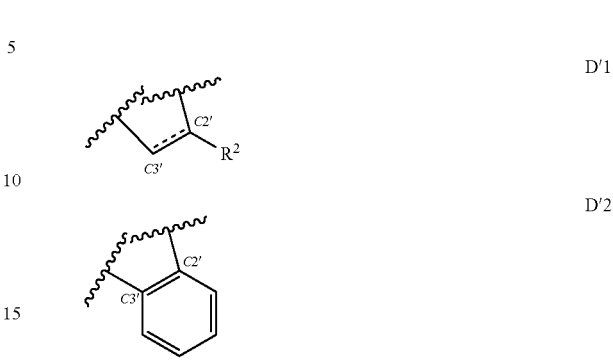

D'1

D'2 wherein the dotted line indicates the optional presence of a double bond between C2' and C3';
  $R^{17}$ is independently selected from H, R, OH, OR, SH, SR, $NH_2$, NHR, NRR', $NO_2$, $SnMe_3$ and halo;
  R" is a $C_{3-12}$ alkylene group, which chain may be interrupted by one or more heteroatoms, e.g. O, S, N(H), NMe and/or aromatic rings, e.g. benzene or pyridine, which rings are optionally substituted; and
  X and X' are independently selected from O, S and N(H); and
  $R^{22}$, $R^{16}$, $R^{19}$, $R^{20}$ and $R^{21}$ are as defined for $R^2$, $R^6$, $R^9$, $R^{10}$ and $R^{11}$ respectively.

2. The conjugate according to claim 1, wherein $R^9$ is H and $R^6$ is H.

3. The conjugate according to claim 1, wherein D is D1, there is a double bond between C2 and C3, and $R^2$ is:
  a $C_{5-7}$ aryl group which bears one to three substituent groups selected from methoxy, ethoxy, fluoro, chloro, cyano, bis-oxy-methylene, methyl-piperazinyl, morpholino and methylthiophenyl; or
  (b) a $C_{1-5}$ saturated aliphatic alkyl group; or
  (c) a $C_{3-6}$ saturated cycloalkyl group; or
  (d) a group of formula:

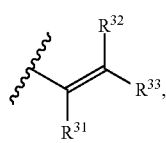

wherein the total number of carbon atoms in the $R^2$ group is no more than 4; or
  (e)

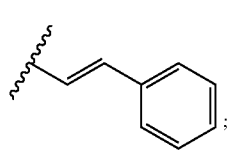 [SMILES: */C=C/c1ccccc1]

;

or (f) a group of formula:

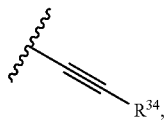

wherein $R^{34}$ is selected from H, methyl, ethyl, ethenyl and ethynyl.

4. The conjugate according to claim 1, wherein
D is D1, there is a double bond between C2 and C3, and $R^2$ is

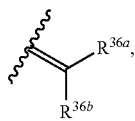

and:
(a) $R^{36a}$ and $R^{36b}$ are both H; or
(b) $R^{36a}$ and $R^{36b}$ are both methyl; or
(c) $R^{36a}$ and $R^{36b}$ is H, and the other is selected from $C_{1-4}$ saturated alkyl, $C_{2-3}$ alkenyl, which alkyl and alkenyl groups are optionally substituted.

5. The conjugate according to claim 1, wherein $R^{10}$ is H, and $R^{11}$ is OH.

6. The conjugate according to claim 1, wherein $R^{10}$ and $R^{11}$ form a nitrogen-carbon double bond between the nitrogen and carbon atoms to which they are bound.

7. The conjugate according to claim 1, wherein $R^{11}$ is OH or $OR^A$ and $R^{10}$ is selected from:

$R^{10a}$

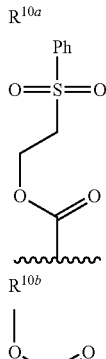

$R^{10b}$

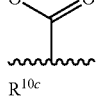

$R^{10c}$

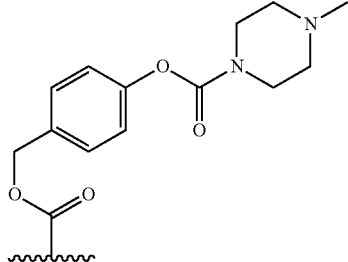

$R^{10d}$

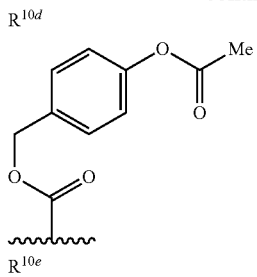

$R^{10e}$

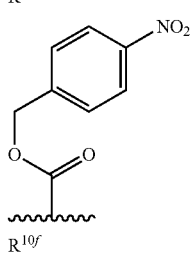

$R^{10f}$

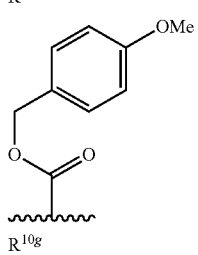

$R^{10g}$

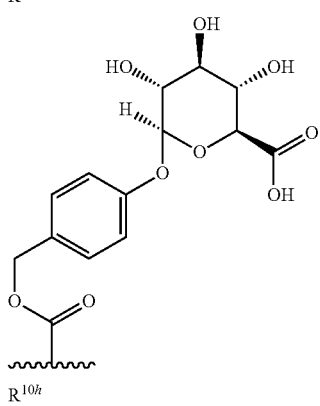

$R^{10h}$

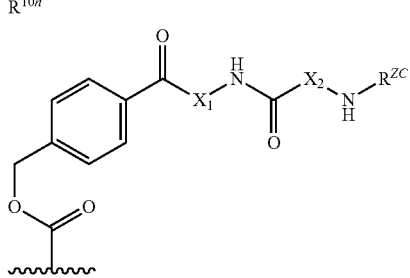

wherein —C(=O)—$X_1$—NHC(=O)$X_2$—NH—, selected from: -Phe-Lys-, -Val-Ala- -Val-Lys-, -Ala-Lys- and -Val-Cit-.

8. The conjugate according to claim 1, wherein $R^8$ is $OR^{8A}$, where $R^{8A}$ is optionally substituted $C_{1-4}$ alkyl.

9. The conjugate according to claim 1, wherein $R^8$ is of formula A*.

10. The conjugate according to claim 9, wherein X and X' are O, R" is $C_{3-7}$ alkylene and $R^{17}$ is $OR^{17A}$, where $R^{17A}$ is optionally substituted $C_{1-4}$ alkyl.

11. The conjugate according to claim 9, wherein $R^{16}$, $R^{19}$, $R^{20}$, $R^{21}$ and D' are the same as $R^6$, $R^9$, $R^{10}$, $R^{11}$ and D respectively.

12. The conjugate according to claim 1, wherein L is of formula:

-L$^A$-(CH$_2$)$_m$- ehere m is from 0 to 6; and
L$^A$ is selected from:

(L$^{A1-1}$)
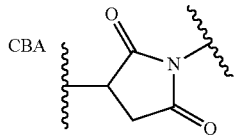

(L$^{A1-2}$)
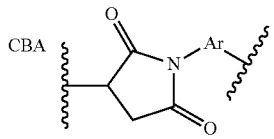

(L$^{A2}$)
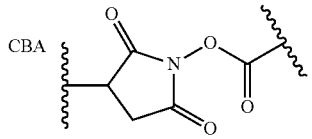

(L$^{A3-1}$)
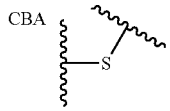

(L$^{A3-2}$)
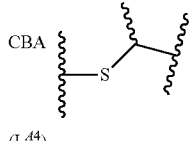

(L$^{A4}$)
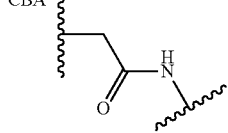

(L$^{A5}$)
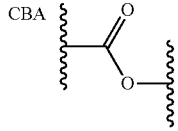

(L$^{A8-2}$)
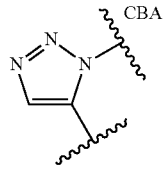

-continued (L$^{A6}$)
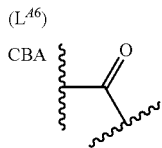

(L$^{A7}$)
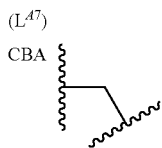

(L$^{A8-1}$)
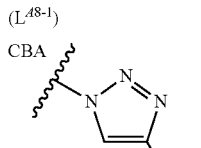

(L$^{A8-2}$)
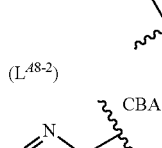

(L$^{A9-1}$)
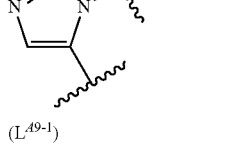

(L$^{A9-2}$)
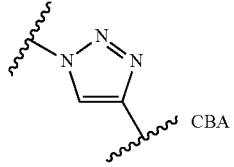

where Ar represents a C$_{5-6}$ arylene group.

13. The conjugate according to claim 1, wherein Q is selected from:

$^{NH}$-Phe-Lys-$^{C=O}$,
$^{NH}$Val-Ala-$^{C=O}$,
$^{NH}$Val-Lys-$^{C=O}$,
$^{NH}$Ala-Lys-$^{C=O}$,
$^{NH}$-Val-Cit-$^{C=O}$,
$^{NH}$-Phe-Cit-$^{C=O}$,
$^{NH}$-Leu-Cit-$^{C=O}$,
$^{NH}$-Ile-Cit-$^{C=O}$,
$^{NH}$-Phe-Arg-$^{C=O}$, and
$^{NH}$-Trp-Cit-$^{C=O}$;

where Cit is citrulline.

14. A pharmaceutical composition comprising the conjugate of claim 1 a pharmaceutically acceptable diluent, carrier or excipient.

15. A compound of formula (B):

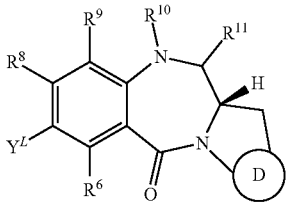

wherein:

$Y^L$ is selected from formulae B1 and B2:

(B1)
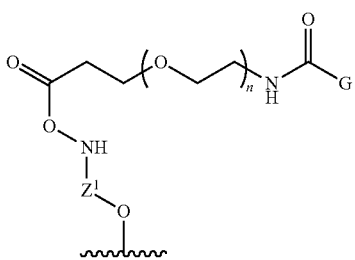

(B2)
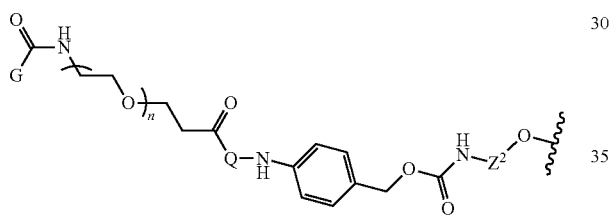

G is a linker for connecting to a cell binding agent; and D, $R^6$, $R^8$, $R^9$, $R^{10}$, $R^{11}$, $Z^1$ and $Z^2$, Q and n are as defined in claim 1.

16. The compound according to claim 15, wherein G is of formula:

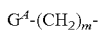
$G^A$-$(CH_2)_m$- where m is from 0 to 6; and
$G^A$ is selected from:

($G^{A1-1}$)
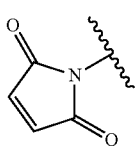

($G^{A1-2}$)
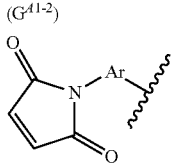

($G^{A2}$)
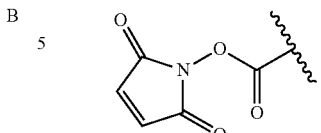

($G^{A3-1}$)
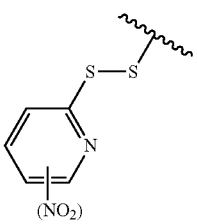

where the $NO_2$ group is optional ($G^{A3-2}$)
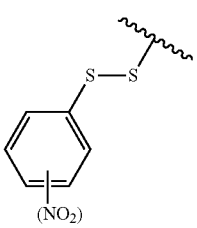

where the $NO_2$ group is optional ($G^{A3-3}$)
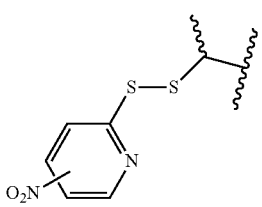

where the $NO_2$ group is optional ($G^{A3-4}$)
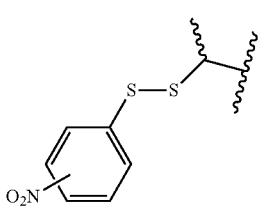

where the $NO_2$ group is optional ($G^{A7}$)
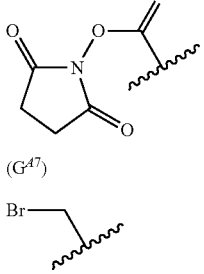

-continued
(G43-2)
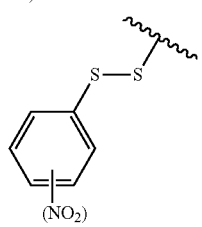
where the NO₂ group is optional
(G44)
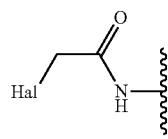
Where Hal = I, Br, Cl
(G45)
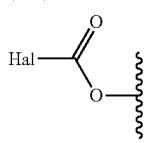
(G46)
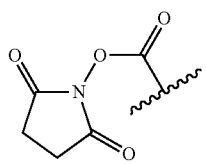
(G47)
(G48)
-continued
(GA9)
where Ar represents a $C_{5-6}$ arylene group.
17. A compound of formula (C):
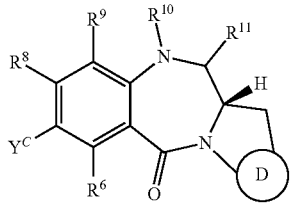
C
wherein $Y^c$ is selected from formulae C1 and C2:
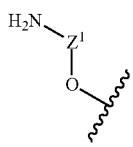
(C1)
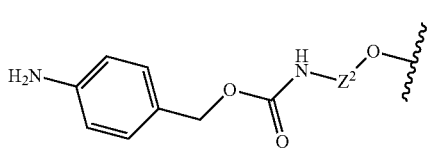
(C2)
and
D, $R^6$, $R^8$, $R^9$, $R^{10}$, $R^{11}$, $Z^1$ and $Z^2$ are as defined in claim 1.
* * * * *

UNITED STATES PATENT AND TRADEMARK OFFICE
CERTIFICATE OF CORRECTION

PATENT NO. : 10,188,746 B2
APPLICATION NO. : 15/510397
DATED : January 29, 2019
INVENTOR(S) : Philip Wilson Howard It is certified that error appears in the above-identified patent and that said Letters Patent is hereby corrected as shown below:

In the Claims

In Claim 1, Column 144, Line 2, "D2" should read --D'2--;
In Claim 12, Column 147, Line 8, "ehere" should read --where--; and
In Claim 15, Column 149, Line 15, "formulae" should read --formula--.

Signed and Sealed this
Ninth Day of April, 2019

Andrei Iancu
*Director of the United States Patent and Trademark Office*